United States Patent 12,790,634 (MOST PROBABLE NUMBER ANALYSIS OF HETEROGENOUS POPULATIONS) - sequence listing, part 29

SEQ ID NO: 18 - DNA, 3616449 bp, unidentified (residues 1,808,226-3,616,449 of 3,616,449)
  source 1..3616449: mol_type = genomic DNA; note = Thomasclavelia ramosa
agcagtcacataatcagcaatttctttaactttatcattaccattttccattgccactgataatgccacatgttgtaacatctcaatgtcattcccaccatcaccaaaagccattgtttcattacgatcaatatggtaaaaatctaaaaacttatcaattccattttgttttgttcctcctttgggagaaacatcacaaaaaagtggatgccatcgcgcagaaatacaattaggcataatctgcattaatttttgttcttcctgctcatcaataaagcacatacattgataaatttttttattaactacatcactacaatcaccagctggatgatcatcattcaaagtaatgcgatgaatttcatcaactcgagcatcacgaagattaaaatatttattatgttcttccgtgaacccacatggaaaaggatggtcttctaaataattcaaaagtttctgtaaatcatctcgtttaattgtattttcatatattatttgattatcaacataacaatactgaccatttaaggttatatagccatcaaactcaatctcatctaaaatatctaaaccatcctttccccgtcctgtagcaacaaaaattttgattcccttttcttttagcttctttaacgactcgatagttgaggcaggtatttgatgatttttaaaactcactagtgttccatcaatatcaaaaaatatcgcttttatcatttctgtttctccttttactaattaatatgagtatatcatttgtaattataatataaatactatttttattaactgaagtctaaaacaaaggagttaactcctttgtttactactgctcaaaaattcttttatagcagtggatgctgccacggcatttgataataacgaaggatgcttacccgttggaaagataatcattttaacaggtggatgctcgtatataattttttcatattcttctatgatatcactgtgtaacatcgcatccttcccactagtaattaacaacaatagtacctttaaagtatttaaaggtacttctacggtaaacctaaatcaattcgtcttaacagtgcctcagtatcttgattcactaaagtctcccaattatcactttgacaccattgataaaattgtcttgctgcaagattgtttattgccatgactcactcctcgattaatgctttggcaaatccccgacgaagagttcgcccatcaaaactatctgccactacacaagtgattaaatctgagcgtcttaatgcagcattaactgcaccccaaacacctccacttgtttcgattaaagtaacatctttaatatttaaggattctaataaagcgattacctgatcagcttcttgtcaccataagtcagtaggaaacctcgctattcactgtaatttaccatgtcctaaaaaatcaattaaaataagtttatactcatcttgatatagtgataaaatttattcaaacattccagctgatgctgtatttccatgcaaaaacaatagcggttactcttcccctaacatctgacaataaacatttttttcttgtatttaaaatatatcatattctgcctcctgaattttttatcgagcaaggctataaacagtaaagccctgcatgctactgtttaatccagatccccattcccatcgctcctttttgaacaaattttatatacatttatcatatcatcttattttatcttccacaaacgaaacacctgttcaacagtagctattaaattatttttagcattactgctctccattgcttcctctaaagttgtaacaccacgaacaatcggaaaataagcatcgataccttggtgattacattcattagcatccgctgtcacacttccagcaaaagcaattactggcttatgatacttcttcgctaatttagcaacccctattggagctttacccatagctgtttgaaaatcaagacgcccttcaccagtaataacaatatcagtatcctttatatattcttctaatcgtgtttcttctaaaacaattttaatacctgattctaattgtgcatttaaaaatgtcaaaaatgcaaagcctagaccaccggcagctccagtaccgggtagttccggatcagcgttaggatattttaatttcgctaatttagcataatcattaagccccttatccattttttttatcatttcagcagtcgcccctttttgcggtccataaacagcactactccctagtttaccacatagcggattattaacatcacaagcaattttaaaagtacactcgttcaacgaagaaacaaccccactgtcatcgatttcaactaattgttccagtccttgtgctccatatgttacttgatttccatatttatctaaaaaacggtaacctagtgcctgtaacattcctattcctccatcatttgtggcactaccgccaatccctataataaaatgccgacatcccattgtaattgcatcagcaataatttcaccaacaccgtaagttgttgtcagtaagggatttctctgatctggagctaccaaagtaattcctgcagcactcgccatttcaataactgccgtcttcgtttctgtaataattccatattgacaaactactctagtgcctaatggccccgtaacttcaagagaacgcatatttccatccataccctcggttaatgcctcaaccgttccttctccaccatcagctagtgggcttactattacttttgcatcatcatatacatgctctattcctgctttgattgcttctccagcttcaattgaagataaacttccttttaacgaatcgatcgcaataactattttcattattttatcccccttgtttttcttagttataatataacaaattatttttataaataatatgttataattaacatgttatttaaataaaatgcatatttatttagtacttataccaaaggaggattatatgtatattaataaccaattagctactcaaatcgttgaaacagttaaagatatttgtgaccacgatattaattttattgattgtcaaggaattatctatgccagtacagatataaaaagaattggttccttccatgaagctggtcttttagccatcaaggagaaaagaattatcgaagtgtatgatgatactagttttaatggtagtcttcagggagttaatttaccagtctattaccacgatcaaattattgctgttattggaatcagtggtaaacctgataaagtaaaaaaatatgcctatttagcacaaaaaatcacaaatctattaattcgagaaaaagagctgaatgaatttaatcgtagccaggctgaaaaaatgcattatctgttacaatcattactagaccaagaaaaccttgactcccaatatttttcagatatgttaaaatattttcagttagatttaaaaaacaattatcgtcttttgattattttagcaaaacggctcgtaaatgagcagtctattatccaagaacttcatagcttagccattccggtatatcactatcagtaccccaatcgttttctagcaataatagatgctgattactttaatagatgtgaatataagctcaaaaaacttgccggtaatcaggtttcaatagctgttggtaaacaaattcctttaataaaacttagtgaatcttatcattctgccttaattgctctaagaaatattcaagaccatcaatatattaactatgatgtgttaacacttgaaattattcttcaatcaatatccatttatgacaaaaaagactatctaaataaaacaattgcaatgttatcattagaagatttaaatttattacacatatattttgaagaggatatgtccttattaaatactgctaatcgtctttttatccataaaaatacattacagtataaattagatcgtatccataaattatgtggttataatccacgaaaatttcgtgatgctaatattttatatttagctttaaaattaaaataacaaaaattagtatattactattttttattcttcatgatattgccaattccagtcaccatgataaatcatccgtttgttcattccgccatcaatcgtaatcgtttctccggtaataaaatcttgcccacataaaaataaaaccattttagaaatatcctttggtgttcctactttcccagccggtagagaagccttatcaagttcaccaaaattttctatttcatcaacattgatccatccgggagcaatacaattaactaatacgttaggacccagtgatatcgctaatgcatgtgttaaagctacgattccaccttttgcactggcatatgcctcactatcgggctctgactgaaacgctcgtgaagaagcaatattaataatctttcctttatttttaattaattcttctttacacaatcgacttaattcataaggggcttttaaacctattgaaagtacataatcaaaagtattataatcaatatccgataatattcccctcatccctttacaggcattattaactaatacatcaattcgtcctaacctttttttagcaaaatcaacataatttttcaatgtatctggatttgctacatcaccgtaataatagtataaatcatgatattcactttcaaagcgttttgatgcctcttcattaatatctatgaaacatactttatccccttgccttaaaaaatccaaacaaatttgttttccaatcccatgagcgccacccgtaattaaaataccacgttgcatcatcaattcctcctttattatcgtttttactttcctaaatacttctagttcctagaattcaacatccatagcttgctattttccactcaccatgcatgttaacttccaaaattaaaaaaaatttatcacaaatactgttaatctctaaattttcgataccaattgtctcgtcaaccttgattttaccataaacaataattttcccaccatcaaaattttaattttgctcatttgtttcatcaaaagataattccaataaggtgcaatttgcaaattccatttcaatttcatccatagctgcattgatttcaatttgattatatcgtgtttctgttttaatttctcgactcacagctgttttacatccacataaaataatactaattaaaatttttttcatataaccctcgatttaaattatcaactttttctaattatagcaattatttttcatcttggattaagtaactgtacaatcttcatacttattataaaaaaagaattatgatatcttaataaagatatcaataattctttctattatacttcaataaaaacagtgttatccataattaatcgacttgctttaactctatttaaatcacgtttcaaactttcaatatcaatttgatttaaaacatcttctttagacacttgattatgtgcggcaattgcttctacttgttgatttgcttcttcatcactagtctctaaattttcaatcgccacaatttcatcaataatggcttcaaaagttgcttgttgtttagctgaaggtgctaattgttgtaataatgtctcttgattcattcccatcatttgtaaatattgttctaattgcattccttgactagcaagttccatactgatatgttgaagttgttgttgcagcgctttttcaatatcactttcctctacttctacttcacagtcatcaattaattttcctaatgctgcattttctttagcagccataaatgcctgttcatgttgggcttctaaagatgcttttatattatcgcgtaattgatcaatcgtttcgattccaggtgcatttagtgatgctacaaacgcatcatttaactcagcttcttttttctcttcaattttatgaacagttaccttaaaaacaacatctgctccagcaagatctgcagctccataattttctggaaaagttaaatttaattctcttgtttcaccttttttcatcccaatcatttgttcttcaaatccaggaataaattgaccagacccgatttctagttgaaaaccttcagcttttccaccatcaaaagcaacttcatctttaaaaccttcaaaatcaatagttgttacatcgccattagtaacatcaccatctttttcgattagacttgtactttgagcaactaaacgttgaatctcattatctacctctgtatcagcaacaggttgttttgttacttctgcctcgattcctttataattgcctaacttaattactttactcatatatttcctcctattcgcaatattaagattctaacataaatatcaaagtaacttaagtattaattagattttattttatattattaaaataaaatttatttttctatataaacagtgttgatctagcattttaaaggtataacaaaattttgtagggtttttcattttcttgctttaacataagtaggttttttcaacattaaaagggttccttgttataattattttgtctagatataagtataaccagagaagcccttatgaaaaattttatcattaatttattagatttaaaacaagaagaggtagaaaacattgagacagtaagaaactcaaccacaaatattgttatatgtacatcttaatggataaccttgcagatgtcctcaatgtcttaaactaacttctaaagtaaaagaatataaaaaaagaaaatatgtttatcaaatcataaatgctactgatacatatattaattacgaattaagaagaatgatatgtccttactgaaggaaaacatttaatgaaccaaattcttttgataagagttatagttctattacaaatgttacattaatttctatattaaatgatcttaaacattatacagctacttactcatctattgccaaatgctataacgttagcccttcaacagtagtaagaatatttgataatcatgttcaattaaaaagacaccacttacaagaaatcatatgtatagatgatttctatttcgacagacgttctaaatataaatatgcatttatgattatgggattcaaaaactaacttatcctagatatcgttgaatctagatgtgaagagaaacttaatgattatttcttctccattcctaagagtgaacgtgataaagtaaaatacatttctatggatatgtataatcattaccgcactttaatgagactatattttcctaaaactataatatgtattgacagtttccgtgttttaaagaagattacagtctgtctaaattcagttaggaaaaggatattaagacgttacaaagatagtcaagaatacaaattattaaaatatagatacgaactgcttttaaagagtggcgataaaataaatgatgaaaagtacttttttgatcgtacattaggttatacaactagtgaagctggagtattagaatgtgttctttctataaacaaggaattaaaaatggcttaaatttaaaagaagattatcgtgtatttaatgatgttaaagaaaatgaatataatgaagaagaatatctaacggatgtattgaaggaaaaaataattatgtaaaaaagattctatctaatgtaaatggaatgaccaattttgacagagctagaaatagaattatgtattctcagaatcttttagatacgtatacaatttctattaataagaaacaaatcaagaaaaacaaaaacaaataaaaaatgaaataatactatatctagacataaaaaagtaggataattattgaagattatacatcttctaatcctactttttgtttagtaccctatattattttaaagcaccattttaaatgactaaaccaacactttcattaattctataaaattatactttttcaacagacattactacaattaccgcacctattaatgatagaacagcactaattaacagtacttggctaacaccaactgaatctagtaacatcccaccaatcaagttaccaaaaacccctgctactgtcattgaagtagtcacaaatgattgacctttaaccatatcttgtggggcaattttacaattcacataataaacagatgccggaataaataaagcataagcccccatttggaaagcttgagctatataaatcattgtcattccatctgcaaaataagtaatcacatgttttactaagaatagaataatagaaattttaattaacgttccacaattaacttttttactaagcttcgtaaaatatgccattgtcggtaattctaacatcgctgctaaaaatacagcatttcccatatcactactattaccgcctacattagtaattatttggataaagaaattattaataattgtatgggcaaaataaacaaaaacaaaccctaataaaaatacaataaattttttatatttaccagcaaatcttagcaaaccttcattatttactgcaacttcatcctcgtcatttgtctcaactgcaacttcgatttgttcactttttggcaatacatagccatgaacaacaataaataatagtgcattaaagacaacataacatactggtaataaatccggactaaaagcatcaactgcatgtcctaataccattgatgcaacagcgtaagcaacagaccccagccctcgagccaagccataattcacttgaattccatacttttcaaaaacaaatgccaaagtattcattagcggcattatcgttgtcattaatgaaaagattgatacaatcaaaataaaaataattgcctgattacttggaactactaataaaattgcagataaagcaattgctattgcaacgatagttgtaataattttacgaatttcaatcttttgattcttatcagcaaaagttgctaatgccggttgcatgaacaccgctaaaatattgcatagggacaaaattataccaattgttgaattactaaaacctttgtgcaataggtatactgaggcatatcccatcattgcggcaaaggttgcaaaataaaatacttgactggctacatacttgatatttaaactttttactctactcattttcctacctcattaaatcgctttcattatttctaatatatcattatttttaatattaaatccagcattttcaaaagttgaaaagtcgctttcatcaatattaatcgataccggcatttttatttccaatgttactaaaatattatcatatttttatatatattttcattgataatcaaaaatccacatcagtgcttgctgttactataaccattccctcactctctaacttctcaagcctataaaattattataactaaaaatcatttcaaatgaaatcttaatcttttcagtcagtaaaatcagattaattcttttgtgaaaaatattgtaacagcttgcttttattatcatcttagttgacaaattttgttcattggaatattatacaaatatagttagtttaagctaactaaaaggagagatattatgaaactagtattagtacgtcatggagaaagtgactggaataaattaaatctttttacaggatggacagatgtagatttaagccaaactggccatcgagaagcaatacaagcaggcatgattttaaaaaatgaaggttatgaatttgatgtgtgctacacttcttatctgaaaagagccattcacacattaaatcatatattagatgaaatggatctctgctggctgcctgtcaataaaagctggaaactaaacgaacgtcattatggtgctttacaaggattaaataaagcggaaactgcagaaaaatacggtgaagaacaggtgaaaatttggcgtcgttcatttgatgtactgccaccagctttaaatataaatgataaacgcagcgcgcaaaagcaggcaatgtatcgaaatattgactctgctcttttaccagcaggtgagagcttaaaaacaacaattgagcgggttattccttattttaatgaaacagtaaaaaaagatatgcaggctggtaaacgagccttaattgttgcacatggtaattcattaagagcgttggttaaatactttgataagttaagtaacgaagcaatcatgaatattaatattccaactggaattcctttagtatatgaatttgatgatgaatttaaagtaataaaacattactatttaggtgatgaaacgctattaaaagagaagatagatgctgttgctgatcagggtaaaaaactagttactgtttaattatgattgaaacattgatccttttagcattattgctaagtttaattttctatattaaagcttatttaaaaaaaaatcttttaaagcgttatcatcaataaagcacatatacttgaaatacctctaaattaaataatcctcaaaaagtcaacttatacattattcaaaagttggcttttttatttattccaattaaatttttataaaaacaaatttattactttcaacctaaaattttattgtaacgattgacatcaagtgcaattacttttatactgataattagattatcgataatttaattatcagtataaaaggaggcgataaattgtcaaaacccgataaatctattgatccaagaattttaaaaagtgctaaagaagaatttttatcacaaggttatgagaaagcttctttgaaaacaatctgtgcaaatgcaaaggttactacaggggcactttacaaacgctataaaagtaaagaggaattatttacagcagtagttacccctactttagaagctttaaatgaagtcgctgacaaccgtaggatcaattttgaaacatttacagaatttgaattaattgaagcctggaatatgaataacgatgtaatgttatggtggtttaaatttttatatagccattatgatggctttattctattactatcatgctcacaaggtacttccttttctaattttactcacgactgggttgaaaaaatgtccatctatacttatgaatattatcttgaagctaaaaatcgaggaatttttactacggaaatcagtaaaacggaatttcatactctactatcttctttttggactacgatctatgagccattcatccatggttttagttgggagcaaatagagaatcattgccaaattgtctgccatttctttaactggtaccaagttcttggatatacacgttaaactccctagatgggagttttaaaaaaaacttaggttagctaaaactaaccagaaagaagggattacatgcttaaaaaagtattagaatacgctggtgattatcgaaaaaaaacttatcaagctattgccacaatgctgattggagtaggaatgaatatcttaccatttctttttatctatcaaattattacacctttaatcatgcatcagcaaataagcactcattatattatttttagagttattgccattgcaatttcacttatcttatatgccgttttttatgttaaaggtcttgccttatcacaccaaagtgcatatcacacattaaaaaatctacgaatttctttacaatgtaaacttgaaaagcaaccattaggagttattcaagaaaaaggagttggtgctcataaaaaaacttttattgatgatattgaagcaattgaactactattggcacatgctttgccggaaggcatctcgaacttagctattcccctcttcatctatattgttatgtttattgttgattggaaacttgccttattatctttaggttctcttcccattggtttattagcgatgggggcaatgttcaaaattggtatgaaagaaatgagtaattactacgtagctgcacaaaaaatgaataatactattattgaatatgttaatggaatggaagttgttaaagtattcaatcgcgatggtgaatcatatcatcgttttgaaaatgatatacgtggatatcgtgatttcactcttgcctggtacaaagcttgttggccatggatggcactctataatagtattttaccgtgtgtagctttacttactctaccatttggatcttggttagttcttcacaactattcgagtttacctgacttagttcttattctttgcttatcattcgcaattggtactccgcttttacgggctttggcgtttgtctcaactttaccacaaatcagttataaaattgagtctcttgaaaaaatgttaagtgcaccgccactacaacaaacatctgattgttttaaagacagaaaccatcatatcagctttgataatgttagttttgcatacaataataatgtagttttacataatattaacttagaaattaaagaaggctcactaacggctttgattggggaatctggaagtggaaaaagcacattagcaaaactgcttgttcatttttatgatgtccattcaggttcgatcaaaataggaaatcaagatttacgacaaatgagcattgaaacgttaaataatcaaattgcctatgtttcacaagaacaatttctatttaatacaactttgatggaaaatattagaatgggacggcttgatgctagtgatgaagaagtttatcaagcagctagtaaagcacagtgtgatgaatttttaagccgtcttgaattaggaattcatactttggcaggtgatggaggaaaacaattatccggtggtgaacgacaaagaatttctcttgctcgggcaattctcaaagatgctccaatcattgttcttgatgaagctactgcatttatggatccagaaaatgaagaaaaaatgaatgccgcaattgcagaagttatcaaagataaaactgttattgttattgcccaccatctacattcaattatcaatgcacatcagatttgtgtacttaagaatggctatttaaacgcagtaggaactcatcaagaacttatagatacttgccttgaataccaaaagttatggaccatggcaaataatagtgctaattggagagttagtcataatcaaggaggtaattaattatgatctcattaatgtcacgaatccttgctatcgccggaaaatatcgtcgcaatattaaaatcgcttttattttctcgtttttaaaatcaatgttagcaaaatccccaatcggactagcatttattgcttttaatgctttttataataataaaatgtctgatcgattatgttttctgcttggtattacattaatagtttgtgttttatttcaagcagtttttcaaaatatttctgatcgtttacaaggtgattctggttatcgaattttttcagatatgcgcatggaattaggccgtcatcttagaaaattgccaatgggttactttactgaaggaaatattgggaaaattagttcagtattatctacagatatggtctttatagaagaaaattgtatgaccgtgattgctgacatgatgagctatatttttgctgaaattattatgatcatctttatgttctatttaaatatttggttggggatactttcattgttaattgctggagcaatcctatggttaggtaaagcgatggaacaacaaacattagaacattcaactatcagacaagaacaaagtgaaaaactcactaatgctgtacttgattttattgagggtattagtattattaaaacttataatctgttaggtgaaaaatcagctgaactttctaataattttaaagagagctgccgaactaatttagaatttgaagaaacacatgctccctggcaacgttggctaaatattatttatggtttaggaatagctgctattttagcactctcattatatctacaaactcaaaatttactaactgttccttacttgattggagtaactttatttgtatttgacttatttggtccacttaaagcgttgtatagtcaaagtacacggttaactgtaatgagtagttgtatggatcgtgtcgaagatgtcttagctcaaaaagaactgcctgatgatggtatggaagtaattccagaacaaagtgatctaccagaaataaaatttaaaaatgttagtttctcttatgataaaaaagaagtattacacaatataaattttacattagaaaaaaataagatgcttgctcttgtgggtccatcaggaggcggtaaaagtacgattgctaatctattaacacgtttttgggacgttgatagcgggtcaataaacatccgtggaacaaatatcaaaaacgttaaacttgctgatttaatgaatcatatcagtatggttttccaacgtgtttatttatttcaggatactatctataataatattagtatcggacgacttgaagctacggaagaagaagtcattgaagcagctaaaaaagctcggtgttatgattttatcatggcactgccaaatggttttcaaacaattattggggaaggtggtacaagcctttccggtggtgaaaaacaacgaatttcaattgctcgatgtattttaaaagatgctcctattattatccttgatgaagcaactgccagtattgatggtgataacgaaaattatatccaagaagcaattacacagttatgtcaaggaaaaaccttattagtaatagcacatcgtttaaatactattcgctacgcagataagattcttgtcatagctgatggaaaaattgcacaaagcggaagccataaccagttaatcaaacaaactggaatataccaagattttatcaatgtccgtaataataccaaaggctggagccaataaaaacatgacttatgtcatgtttttattgtttattaagttaatcaataaaataatataattattaaataaagtgatgagttattatgaaaaactacctatacatcaatttacttagttgattcttttaataatgattttggtgaatttttattaccagaaatcttagaatcattttattctagctgtaaaagtagatttatgataataaggtatattagaaaattctaaagaccctgtaaaaagaatttataatttttagctgatttggcttagaatttttcttagttatattaccattaaattttttatcattttaaaatctttctcatttcctattgtatcgctaatggtgttatccatcatgatattatcctttggaggcgagctcctgtctgaatgctttagtattaacaaaagacccagatacgattgaagcaataattcatgactttgcagctgttgttgattttatagctccattattctttctactattaaacagtattatccaatttggattcaaccgcatagctattgaaatacttttccttattaattttataatcacctttatttttttctcttttttattatagataataaaggataatttaaaatacatttgttacgtatgaatgtttctagcaacgtgcaattttaatatgcttgtatttccttttctattttatgcaattaaatcattatgtttttgaacctgtatatttttatcaataacggctatgatatgtttagaggtgagtgacattaaatatcaaaacttacatgaattaatccagcgcagttctagttctcgcgaatattttttatcattaccagttgatacacaactaagattacatgtgcttaatgattatattcattctctacatcaattacacatttatgctgaaatcagcaaataacgaaattttcttataaaaatatataccattaaaattcagataaatgaacggataaaatcaaaaccaaaaatatttgattttatctttttattttaaaacatattaacagcatttttttaataaatttctattcaatcaatttttacaatatctatgtttatactcaaacaaaaattctatgctaaaaatctaacaacgttttcaacttttcaaaactgtcatcactaattccatgttccattttacaagcttctatttctgcttggtttgaacttacgccagcagcgattaaaagttttttaaaaaacagtgtcgttcataaattctattagcaagtacttgaccactcgatgttaacttgagatgaccatctttatttacttctaaataatttttatttctaagctctttaactgcataactaatacttgccctagaatatcctcgatacactgctaaatcaacagaacgaacggctttattttgattagataaaattaaaatagcttctaaataatcttccagtgcttctcccataaccacttctcccttaaatttattaattttttatagtatagacatttatttatcttataattcaattgattataaaagcaagtaaggaaatctccctacttgcttaattttcttttttataaagaagcggttttgttgagacagcagaaaataggaatgttgaagtattgtgtaaaaatgcacttgtattaggctgtaataatccaattagtccagataaaattaataaactattaaatgccacgatattagtataattatgttttattctttgcattagtaatatcgaaatctttttaaattcaacaatttcatccaaacgacttgaagtcaatgtcacatctgctagttcacgggcaatatcggaactatcttgcattgaaatagatacatctgcacttgatagtgccggagtatcatttacgccatcacccaccatcacgacttttttacctttcgcttttaacagtcttatatactcagctttatcttctggtaaaataccagctttataatcatctattcctagttcatttgcaatatgccctgcagcgttttcacaatctccagttaacataataacctttttaaaaccaatctcccgtaaattattaattacatgcttggcttccggcttgagcggatcataaatactaatgattcctgctaggcgttgacctattgctaaataaatcaatgagctagctcctttactatgtaatttgctgatcaactgaactatttcagggggtttttcaatctgttcatcatcaaaaacaaaatgctcactaccaataattgctctttgaccatgtaaattagtagcaataccatgagcaataatatattctacttcagcatgttcttcttgatgtaacaattcctcatcttgggcttgcttaacaattgcgttagcaacactgtgagggaaatgttcttcaagacaagctgcaattctaagtacttcatcacgactgtagtcatctagtggtgttacttcttgaacgaatggagtcgcattagttaaagttcctgttttatcaaagacaattgtatcggcttgagccatcgcttcaagatatttaccacctttaaccatgattgaatgttttccagcctcttgcattgcactgatgatagaaattgatgtagtcaatttaattgcacacgaataatcaactaataaaattgaagtcgctcttgttagacttcttgtccataatagcaacccaaagaagccaaaaaagctaaatggaacaatcgaatcagcaagatgttcagctcgcgattgaacaccagcttttaatgtttcattaacatcgatcatatcaacaattttattaatacgactttctttttgtagatttctaacttttacataaatttttccttcttctacaattgttcctgcaaaaacagtatcatccttaccaaccgctttacttagaggctcaccagtaaaacttgattcattgatcaaagcctgaccatcggttatttctccatcaacagggatcatcgtccccatgtgaacaataactatatcacctctttttagagtatcactaggaatttctatttctgactcattttctaagatccaaaccttatctagatgaagtgataatgattcttttaattgtaaagttgttttttttcttgtatagtcttctaataattgtgataccgacaataaaaacataatatcgccagctgttttaaactgtctattaagcatcgatacagcgatacttgtcgcatcaagaactggcacatcaatatgtcctttacctaatgaagctagcccctttttgaaatatttaaccgctaaaacgatactgcttaaatattgtatcggagttggtaaaaaccaccgaattgaataacggcgaagcaataactttataaatttagaagtataattttggctaacttctttttgtgttatttcataagaattatactccttgattgtcgctagatatggtgttacatcaaatttttctatttcaaattgtcgtattaaagctaataattctcttcttctatttttatcataaataaataaaatacttcctgttatatcattagcttcgaccttattaaccattttccaacgttctaattcatagcttaatccaattgctgcagtttttgaaaaagtatatttaccataacgaattcgcattcgtccaggcatatcatgaacaatttgataagctttcataacctatctattctccctcatttttagcttttgcttcgtaacaaatatcttttgcatcttccttgatcgtttcataagtagccatcgcatcgtcttttagcttcattcccgaagctaaagaattaaccgccattgttctagctttatcgctttttaaaaactttgcaccagcaatcgttgctgcaattcctcctacaaaggataatacagttttgttttttaataaatctttcattaatgttcctcctaacttattataaagatgttagtcaaaactaacaccctatactattagaatactctttttttcgtcatagtcaatctaaagttatataagtctaacaaaaaaaccagcaatatcttgctagtttttataatttccactcgttactcattttttgcaggtcaaccattctttgataaaccccttctttacgtaataattgttctggagttccttgctcaactacatgtccatcttctaaaacaatcaacttagaggcattagcaatcgtcctcatccggtgagcaatcataatgacggttcgattagcaatcaaatgtgataacgctttttgtacaaaggtctcactttcaacatccaatgaagcacttgcttcatctaataaaataataggtgcatctttaagaattgctcgagctattgaaattcgctgccgttgcccacctgataattttgaaccattttcaccaataaccgtattatatccatctggcagtttttcaacaaactcatcacaaaaagctttttgagctgcttccatgacttcttcgtcagttgcatcttttttaccaatgcgaatattttctaaaatagtattattaaataaaacaacctcttgaaaaacaatagaaaattttgataatagtatttctggatcaactgtagaaatatcaattccacctattttaataaccccttcgtttaattcataaaaacgagcagctaatgaagcacaggttgttttaccgccaccactatttccaattaaagccgtaatttcattttgtttagcaacaaaacttacatcttcaagtaccttttttttagtttggtactcaaaactaacatttttaaattcaatatcatagttacttggctcgaatttttcttcaccagtttgaaggggataattttctatttcatttagacgagcaattttaggatcgcaactgataatcgctgctaagttttgtaatgttccactaagaggatcataaagacgagaagcaacaattaaaaataacataaagactttcagatcaatcgtttgattgattagtgatgttactccataaatgactactgttgcaattcctaattttaaaatcaattgtgaactaactacaaataaagcatttgtaagttctgttttaatttgactcttttcacaatcatcaataacctgatctacctcattaagatactgctgagtatagtgattagcttttaaatccctaattgtctccagcgtctcttgaatcttttcagttcgaactaattgtttttgacgatctttaaatccagcattacttaattttcgtttagccagaactactaataaaaatgatacaggaacacaccaaacagctgctaaagccatcctaaagtcgaaaaagaacatcgatatagatagtaaaagtgtggaagctattgacccaaagaattcaggaataaaatgtgataaagcctgttccattcccgtaacatcagacaaaattgttgttgttaaatctgataaatcacgttttgaaaaaaacattaacgggaattttcgaagtttttcagcaacacgaatccttaatcttgcactttctttataagtattataaaaagtcatattatattgaatatagtgagcgataaaaattaagataacaactattacaaattcaatcagatacattgaatataagattgtatttgaactgccatatagcatttctaaaacatcacaagtaaaataatataacactccaattgacattgcgattgctaaatatgatatcgtacatgaaacacaagccttaattaaattaactgctcccaaatgggttaaagcaaaacgctcttgaaccttttttatcattcttgttcacctactttccattctactgactgacaatattgatgccacatttgagcatataatccgtttttaattaataattcttgatgcgttccgctctcaataatttcaccattatcaacaacatagatacagtcaacatttacaattgttgaaagtcgatgagcaatcataatcgtagtcttgtcttttgctaattccataattgctttttgcattaagacttcattatcactatcagcgtaagcagtagcctcatctaataacaaaattggagcatctttaacaatggctcgtgctaatgtcagtctttgggtttccccacctgataaataaacccctttactaccaatcttagtttctaatccttgatcaaatttctctataatatcatcacattgagctttatgaactgccgtctgaatatcttcaacacttgcatttgatcccatcttaatattttctttaaaacttttctttaaaagacgactgtcttgaaatacgaatgaaatcttactcattaattctttttcactaatttctttaacatcgacaccaccaattttaatagtccctttagtcacatcataaaatctcggtattagggatactagcgttgatttaccacctccacttttaccaacaaaagcaacaatagaaccactttttattttcaaattaacatcatgaatgacttcattttcactttctggataagtaaaagagacatgctcaaattcgatatcactattggtgatttcttgcagactatgcttatacgtaaacggcttttgattaataattccttcgattcggtttaaagcatctgcagccatcattgtattttcacttgcaaacataattttattagttgttactgcaataattggtgtaaaaataacataaaataagaaatctggcattaaagaatttaaatcaaaaccgtttaagatcaataacatcattgtgccaataatgaaaatgaaaatactattgatgaaggtcgtaaacaaagtcattgggaaacgcatcttatttgtataaccaattgcaaatttttcataattattaattgattgatgaaaacgatcaaaagaaaaaactgtctgttgaaatgttttaacaacaggtatcccacgaatgtattcaactgcttcattactcattccttcaagtgcatccatatatgctttcattgattcctgtaagccaggaccaatcattttaaacatatttgatagtgctaaaatcgttggaattagtgcagctatcccaaacttccaatcaaaaataaataaacagactattaccgcacaaacagtagtaatcaattgtgccatatccggtaattgatgtgctaaataagtttctgttgaagctgcagcttcatcaataatttttcttaatttaccacttccttctttagcaaaatatccaagtggtaattgaacagcatgatgtaaagcttttttacgcatatttgaagcaattctaaatgcagctaaatgtgagcaaagtaagcccgaaacatacaataaaattcctactgcagcaaaaattaacgcgtaccagccgtattgtatcgcaatacttccttgggcaaagtttggatactctgccaaaataacctcaataactttccaaatcataataaatggcattaataataaaatagcacttatcattgaaaatactaaagaaagtattgttaaatatttatatttgccagcataagcaaataaagattttaatactgtcatattaaccctcctttagttagaatagactaactttataagagagtataactcctaaatattattactgctactccattttgttattattgctccattttaagatgtgatttacgatattgctggggtgtcatagaagtatattgataaaatgcagctgaatatttacttggattagaataaccaatctcattagctatttcgataattggaatatcggtattaatcagtagacctaaactatactctaaacgatattctttataccactgatagattggtttaccgtgaatctctttaaatgctttacgaaatgtatgaatattaatattgtattgttttactagtttttcaagatcatatttagctgaaatattgttactaagctctgtttttattgccttgataatctcaatttgtttttttggataataatgcttttcattttctaaaattccaaagtcatgatgtgataaaaataataacagttctaacacttttatttttaggtaattcctctttaattcctcttctatctcatacatttctaaacaaatatgttcaatttgagcagtagcacgaaaaatatatacattatggctttcttttaaacgtttactgattaaatcaatatcaatattgaattcatctaataatttattctctttagctttttctacttcaatcaaaatttctacaccattataataacccaatggaaatgagtgagttaatttatttaatgttccaccactaattgctaaatctccttgacataaatatgcataataatttttattatactgacattcaaatttaccttttagacaatgattaatttcaatataacgatgccgattgagagattgatcagtcggagcagtaaaacaatgaaaattattatatataacttgtatccctggataaatatctatgctcgtcattactccctgtccatcgattaaacctatttgatactctctttcatgcttattaataacctttttatctataaacggcagcttaatatcttcaagcattaaaatctcctccttttaggtgaaaacagaataacctatagttattctgtttcttttaaagatttccctaaatcaattctttgaatttgtttattcaatagccaattaacaacaaaataagtaattaagccaacagtaaaaatcattacatagaggtaggttggaatatagatttctatatatcctgcaaatctcatcattgcttgaataaacaatatttctaaaccatatttacaaattggtaaactaatcaataatgaaaatactactaccaaagctgtagctttaagatatatcttagcaatttcttggctgttatagcctatcacttttaaaaacgacatataattagtatttcgatctaatactagttttgttagaatatacattacaactaaataaataactatcgctatcccactcataatcggaatcatctgtgaaaaggtttccgtcatttgatcaccaattttcagcatatctgtcttagtaatcatcgtactaagatattttttatcaatatttaacttctgatctgataaataactattataataattcagatcttcttcgagtaaattatttaatgattcacgtgacatataaacacttatattagttcggctattataaatatcaaaaacctttaactgatattcttgttcagtatattggtttgtaaacgttactttatctcctttttctaagccaacttttttagcaaaatcgtaggaaataataatttgatctttttcctttggcaaatcaatatccgcataatatatagaattatcatctaatccatagaatgaaacatctaagtcaatttccccagcagcaaaataggtttgtaatgatgtatatgttattttttctccagcagcttcaactggtacctttaaaagatattggtagtttgttttaatactattttccatattttctaaataacgttcaatcgacggggtaatacaaaaaccaaaagttaaaagaaaactagcaaaaataattccaatcattaaaaccaaataacttcccttattttgaagaatcactctttgacgatagcgcttaataaacgacgtttgctttaaatgaatataatgacttttcttattttcatgtagatcttgtcttaaaaattttaatggcgaaatatttaatttatgccataacattaaataattgactatcaaaataaccaaaaaaggaatcacggtagtattaacaaatacactaggaataaattttaactgtaatggtggcaagcaataactgttatagtacatattagaaaaaaatgaaggcattattgtatatccaataacatttcccactagtccacttacaaaaacaatgatcattactaaagtaagataatggtgaatcaactcttgttttgtataaccattagctagtaatgtgccaattgcagttgcttggtcttcaattatcgcctgtgaaattacaacaaaaataaaggctaaaataaccaaaatgatataaaacaacatattcatcattgggatatcaccacccatatcattaggtaaaaatgatattgcctggttcatctcttgggtcatcattcctgttaagctacatccactatcaactacgatatctctaatttgatttaattgatcgtaattttctttactacttaaatcatcatttgatttataactataagtataattaatattattctcttttaataaagcaaaatctgactcatctacaatagcaactccaaaatggataggatccatcattaaatcactattatccttaatcaacgaactatagtcaggtaggcttaaatatccaacgatagttaactttataccattgaccttaatttgatcatttattttataaccattttttattgcaaaaagccgatctaatgctatttcttgatgcttttttgggagtttcccttggtaaactgtaaccaaattaatattttcacgatcttgatatatccttaatgtagcactatttttgatcttttgctcgctatagaaattttcataaagttttacaggctctttttcaatttctttaattacttctttagtcaatggttttaaaacagtaaactgtccatcctcgactaaacattcatcttgattttgttttaatagattattaacactataagctacactaaaaaaacctgaaacagttgcaatcataactatcatgaccaaagcaagtgctagataacgagctaagttatcagtgaattctttttttaaactcttatttaatggatttttcatgctaacaccctactaccattctaactctttagcattgattcgtgatgtatttaaatagtttgaaataatttgtccatctcgcaaacgcagcacgcgatgtgccattttagcaattgcatcattatgagtaacaattaaaatagttgttccataatcctgattaatctgttctaataattctaaaatatctttagatgtatgataatctaaagctcctgtcggttcatcacataataataatttaggattttttgctagagcacgaccaattgcagttcgttgctgctgtcctcctgataattgattaggatacctattgcaatgttcttttaatcctaatttatctaatagtgtttcaacagctagtggtgtcttactcaaatatgcacctgtttcaatattttcttttactgttaaatttgggactagatgataaaattggaaaacaaagcccaaagtatcccgccggtataaccctaattttgtttttgataaagatgctaaatcaattccaccaactatcacattaccataatcaattatttcgatacctccaattaaatttaataatgttgatttaccagagcctgaaggtcctagcataacacagatttcaccgcgttctattgaaccattgaccccttttaaaacttgaacccgattttcattttcaccataatatttttctacattttctaattgcaaatacatataaatcctcctatcttttaattcagatttttttaatttaataacacgatagccaactatctctattaaaacctagactgattccacacttgcatcttgttttggtagaagtacagccaaatgctgttctaaataaattttcttctgattaaactcattttcaatttgttgctgacaatcggtacaactcatcccattaatttccatcatcacacaatatggataattctcatttttcaatcttacaaattgatttttcgaatagaatcatccgattcaccacacaacaccctctataatctttttaaaataggatttaatgctaaatatttcaattaaaacaattataatagttagcctaatctaaccaacaattatatcttatctcctggtgttagacttgtcaaacaaatatataataaaaaaataaactattactagcatagttattatttttaggcaaagtttaatatatcacattgcaatacagtttttaagcttactgtctaccagatagataatcagtaaaaagtatcatagaagcttcatttttagataaattaaatcagcaagatattttgaatgaatatttttagtaaaaggatatccatgagtattacaaagataccgaacttttttataaagttttagcattttttctttaaaaacctgttcaaaagtattagtgatacataattgatgattaacaatagcttcatgttcacgccttaataatagcatcggagctttgacaaaataaaattaaaatcattaaaatagcacctatgcatcgctgaaatactaaagacagtaattaaaggtggctgtttattaaggtgaatagactgtaaaattatataaccgatgattcctactgatgctatcataatgatatttaagtacatgctcgagacaactggtgaaaacaaagctaaattatccaatgatacatccacattaatatttgaaaataaaatatatagcggtgtataaaaaatttctcatcattatcacaggaaacaaaacacaaaaacgactgaattacaataagaatgaaggaatagaccattccatagattataatatactgctattactatagatattaataaatagatcaggctaacaataaatgcgataagcgaagaaaataataacggatttttttattctatacatcaatatatcctcctctaataaacgtttatgcatcaaatagctgaacaataaatcaatcaaaaaagcaaggtagttttctatcttgcttttctaaatattctataaatcatcttcaatagcactagactttgcataagcagtagattttgcttcaaaaaaatcggtcttaatgttatttgcattactataaatacttacccatttcattgcttcaggttctgtctcaaatccttcatataatggttcaaaattcaatgaaaatgctcttaaattaccgagataatgaatataatcactgaccatatccatcgttagaccctcaattcgatttcccaagacatattgcccccaagcaatttcctcttcaactccacgttttagcatattacgataaacctcaatcttttcaggggtaaataatgtcggttcttccttttgcagctcaataatcatatttctaaataaccataaatgtgtattttcatcacgattaatataacgaatctcttgagctgatcccgacatcttacccattcgtcctaaattataaaagaacataaatcctgaataaaaataaattccttccaaaatataattagccataatcgttttcattaaatgaaaactatctttatgttcaagaaatgcattatactgttcaccaataaattcatttcgcttcaacaaatgttcatcaaatttccattgatataaaatttcatctcgtttagttggtgaacaaattgaatcaagcatatagctataactttgtgaatggaccgcttcttgaaatgcttgaatggttaaacaaagattaatttcatttgctgtaatatactcaccaatattaggaagattggctgtctgtaaagaatctaagaaaactaaaaatgaaagaatcttatcatatgcggttcgttctgcctcacttaacaaacgataatctctaatatcttgagtcaaatttatttcttctggaatccaaaaattattcatcgcctgacggtaccaatcactgacccactgatatttcatattattaaaatcattaagatttgttgtatttccatttatcattcgacgttttcttacatcaatatcacctttagcattaaataatgctttttgtttaagttccattattacctcctatgaactgcatgattcacattcttcaacttctaaagactggcttctaacataatataatgttttaacaccatactcccaagctttaatatacaaattaagcaactttctaaaagtaaactcatttgtcatatataaattaactgattgtgactggtcgagatgacgctgcctaattcccgctgctttaacaatccactcttgatcaatataatgcgcatttttatataaccaaaaagtttcagaatctaagtcgggagcaactctagtaatcatacttccctttttctcttccataaaatactttttcatgataggatcaacagctgctgttgttccagcaataattgaagttgaactggttggagcaatcgctaaaagatatccatttcttaaaccattttctttgattttagcttgaagattttgccatgctttactttgatagcgacgttttataaagtatgcacctgtttcaaaatcactaccattaaacaatgagtaacttcctttttctttagctaaatcacatgaagcttccaacgcaaagtaattaatcttttcataaagctgctcaataaactgtaaatgctcatcactttcaaatgacattttcaattttaccagcatatgatgataaccacttgttcctaatccaatcgcacgatatttttgattagttattttggcaaaaggaattggataataatttaaatcaattacattgtccaaagccctaattacaacactgataacgtgtctcaattcatcatcatttaagacatcaagatgacctaatgttaatgaagctaaattacaaactacaaaatcacctggttttgttttttcaacaataatagtttcaccattaacctcaatttcctcagacggtaagatctccatcgcttgcatattttgagcaatttctgtgcaaagattactgcaatatatcattccctgatgaggattaggattaaaattattaacatgatcgcgattaaatgtgaaaggagttcctgtttcaactagtgatttaataattaaacgaacaatttctttaactgtcataacgcgtttaggaattcggtcatcttcaacgcactcataatatttcctttcccactcttcaccataacaatcctctaaataataacctttaacttcatgtatctcgtgtggacacatcatgtaccatgaagcttccaaatcatttttagctaatttccaaaataaatctggataacaaaccgcaggaaaaatatcatgtgctttcattcgatcatcgccattatttgttctaatttgtaaaaattcgggtagatctttatgccatgcatccaaatatactgctgctgctccctgccgaactcctaattgatctactgctgttgcagtatcatttacaagtttaagccatcgaatcacacctcctgctgctcctttgaaacctctgatactacttccattagcacgtacttttccaaaatacagtcccattccaccaccgttttttgaaactttagcaaaattatctatacttttatatattcctgctaatgaatcatcgacagtatcaataaaacatgaactcatttgatgaaatggctttctcgcattagacatagttggtgttgccatcgtcacttttaaagtacttaaaatatcataaatctcttttgcccacttaactctatttgattcattcatggccaaatgcatagcaattgacataaacatttcctgtggtttttcaataatttcgcggtcatgattttgaatcaagtatcttttaacaatcaattcaagaccactatatgtaaataattcatttcgcgattcgctaatatactgtcctaacatgtctatttcatcttttgaatagctttcaagaatatattgtccataataaccttgttgtgctaaatagttaatccgctcataaaaagtatatctaccagcggtattcattttttggtcaacctgttgatttacatcataagttaaaaatcgagctgaaatcatctcccatttaggtgcttctttactaattaattccacactcgctttcatcaacattttcaacgcttcaaaatgactcataccctctttataaaatgttttaaatttcactaataataattgcaatgaatattcttcttgaggatagtctttgtgaatcttcaatagaaccttttttagattttgatctcccaataaggcaagcagttcatcaattatcaatcgctgctccgtatgcttttgacgatataaaatataagcttttgctacttgaagatatccatgtttcatcaatgtttcttcaaccaaatcttgaattgcttcaacagacatatcagctataatatgtttttcaatatctgcaatcatcttttttaattcatcatcttttattgtttcagataaactgcaaaaagctttttttattgctgtttctattttattgttatcatagtcttgaaaaagaccatttcttttttgtatcaacatttttttcacatccttagaatgccattctagcatagtcattcgattatcttcaacgaatatgcttaagcatattttattctttcacaataatcataaatataaacaaaaaaagatgtatctaacaacacatccttttataaaaaaatacttctagttttaaattcaatcgtttgatttaacggtcccaatgaaagcattttcatatctttttcatcatattgaggaaattcaactcttgttatctgattattccaatatgttttaaaataatattctcgagttgctaagttaataaacatcgtatattgagtataatcagaagtttgatctgctgtaatgacgacccctttaggaatactgaccgtttccatgatccggaaacaagttatcacagcttgatgacgatcaattggaatatctgtatatgttttttgaaatgctgctctaataaaacgtgatggtggtgtataatcccctggtaaacctaatgttcctgcaccttgtccaaatggagtaagttttatattgttccatattgcttcttgaaattgatatggcgataaattgtaataatttcgtaaattagtcatatgccaagaaaaatctggactatttgcaagaacaccaataggattattaatcgcatgtagaccatctattgttttttcaatcaccatacaattgttatttgcatcgcttattatccaatgaagaggagctgctatatgtgtaatactatcttctacaccaataattttgatgacttttattaattcttgagcttcttttactgaagcacattgacttaataaaaaataaactagttcaaaagcagcgatcgggataattgatgtattatctttttttagcccatcatattgagcaaacccagaaaaatataatgccgcaactgcaaatccatggtcattaacaccatcacttaaagcaacaggagagacatcttgcccgataccaagaatattgtacttattttcaatatcatgagtatttagaacattgcgccactggtattttgcaggaatataataaagttcaggatttaattcaaatgaaaaatccattgttcgaccaaaataaatatctccattatctgaatatatctttattgctgtacacatctatgattcctcctaatcattcctcctttaaatatattaacctaaattataaatagacccgattaaaatttaaaaaaagggaattttatttccctccttatatcttttctccatttgttgcaataacttctttcatccaatcaaaacttttctttttatatcgattatatgttccgctaccatcatcatttttatctacataaacaaaaccataacgttttttcatttccccggtactaagtgaaacaagatcaatagccccccacatcgtataaccaatacaatctacatgatcaatattaatggcatctttcatgtttttaaaatgatcttttaaatatcggatccgataatcatctataactgtgtcattttcaaaatgatcgatttcacccattccgttttcaacaatcataattggttttttataacgatcataaagttcattcataacatagcgcaatccaacaggatcaattggccaaccccaaggggttgcttctaaatagggatttagatccattgctaatccgataatatttaatttagtgttagcattaacggttgttgttctatagtagctaaaagtaataaaatctagtggatattcttttagtaaatcatcatcacctggctccttaaccagtacgaccccttctttttcaaataatgcttgtgcataatatggatatccgccagttaccatagtgtctgcataaaaatacgataatcttctagtattcatatgtgccatcatgtcctcaggcttgcaagttaatggatataaaccactcattgcatacattgttcctaccatgcaccctggcatcatttcatgagccatttttgttgccaatgaactagcaacaaaaacatgatgcatcgcttgataatgcgtttgactatcaattttatgagttcccatttgagcataaccctttacaacattaagctcattaaatgtcaaccaatattttactttccctttaaaacgttcaaataatgttttacataattttaagtagcaattaattgtatggcgtgatgaccatccatcataatgatcagctaaatatgcaggaatttcatcatgacaaattgtaattaaaggctctatgtgatactttaataattcatcaataacattctcataaaacttcaaacctaactcatttccttcagcctcttcgcctgtcggaaaaattcttgtccagcaaatactaaaacgataaacattaaatcccatttctgccattaaagcgatatcttctttataacgatgataaaaatcaactccatcatgacttggataataacgctcaggatcaatatatccagttgctccttcaggaatttcagcctttaatggtgacgaaccaagcgttccatctttacacttataagttacctgacgtaacgtatcaacattaccatctgttacaaaatctgctgtaatcaagccgcgattaccttcaccaaatccaccctcatattgaaaatcagcactagctccaccccataaaaaattatctggaaatctactcatactttgttcctcctttgatactactattataacggagttttttatataaacttaaaagttcgcattttggaaacttctatattcagcaacaatcaagtcattaatcaaaggatagatataactatgtgtttgtaatttagataaatgctgatagacaagacaaatatcaacatcgggatgatttaccatcatttcgtttgcagtaattaaaataacctttttatttttatagtcgtattttttcttttcatcaaatgatgataactgatacttatttaaatagttaccagaattagaataaatgatcacaacaccttgttcactattattttttaagtattcgtcttgtttaacatcatttacataactcataataaatttatgattataggccagtttatactgcaaatctaacgctcccaattgtgaaaaaagtgttccaaatgccgtgacttttggatattgataaattatttgagcaatttttctaatcactgtcatatcaatatttttgattatttcaatatcctgaataactttgtcaatataggtatttgcgtcttgattagcaatatattgttggatattggcaacataattataatcactgttaaaacgattttccttaaaatatgcttctgccttaaaatcggaataatcttcaaaatttaatgatcgtacaaacttactaatagttgattttgatacatgacataaatttgcaacatcattaatactaagattttgcaaattatcaaaattcaaaagcattgtataagcaatactataaaaagtactatcttcactatattcatttattacatcaataagcctaaccaataatattcccattaacctatctcactttctttgcttattagaatactaatttcatataaattacgtcatccgttggattatcataatgtggttcaatttttttaaaaacatattttttatataacgaaatcgccctttttaacggtttgattgtatccaaaaccatctctttataaccatctccttgagcagtttcaataattgcttcaattaatttttgaccttgtcactgattacgaaaatctggttttacatatagacgtttcatttcacagcattgattaagatggtgacaataagcaatacagccaacagctttaccatcagtcgacaaccgctaaaatacgcccatgagactatagatatcttctttttaaatcttctaattcagcatctatgttttgaaaagagaaatctcgattcaatgaatttgtatactcaatgatcaattcttttatttccgcaagatatttttctccatcaacaatcaacattatttttcacctcaaatataatttattttgatactatcattctaacataaaatagtaatcagccaaactctagattcatttaaaataattgataaaaaagcaaagtcattatgtttgactattataaaaataaggcgtattattcaacatgaacatggttcatataaaattataaggaggaaatattttgaatttaccatcaacatcaaaagaaaaaataatttctatctgtcaacgtttagctaaagaaaaaggtctatcttcaattaatatgcgttctgttgcaattgaatgtagtgtttcagtaggcgcaatatataactattttccatcaaaatcagaactcttatgttcgactatcgaaagtatttggaaagatatttttcacatgtctagtgaacaatttagttttacgaatttcattgaatgtttgacttggttatttgaaagtattcaagaaggcagccaagaatatcctgaatttctttcaaaacatgcaatgtctttagctgctgaagataaagtcgttggacaaaaaatgatgaaaaaatattttttccatttaaaacaaaatttattaattgtattaaaaaaagatcaaaaaataagaaaagatgcttttaatcaaaaattagatcaaactttattcattgagtatatttttgaacttttcattttttcaatcgttaatccacaacaaaactaccaaggtattattgagttagttgaacgatatttatactagcccacttattacgaagtgggaatacttataattcaaagtgaacagtgttcagattaattatggaggtttattatgaaagtaaaaaagcataatttattattaatagcttcaatcgtgtggcttattgctggtttcaatattttaaaaattggaattgaaacatatgttggatatacaaagttattaaatttctttctctcaatcattgtttttattattttttggtttgctatattttacaaattaactaaaaaacatacccatagaattcatagctatgaaatagaaaaacaattctttttaaatttctttgatcttaaatcatttattattatggcatttatgataatttttggtataacaattcgaacatttaatttattaccggatagatttatcgctattttctatactggtttaggagctgcgctatttttggccggtatcatctttggtttaaattactataaatcattaaataagactttagattattctcctaaatctttaataaatattgctattatatattttattttagcaatggctgggggtgttttttatcgtgaatttacaaaattttatgcttattcaatgcctaccgtattaagtgtaattcatcctcatttattaattttaggaacattactgtttatcatcctagctgtaattgcaaaagtaacaaatatacaaaataatagactatttaaaaaatttgtaatcatttataatttttctttaccttttatgatcctcactatgctaattcgtgggattctacaaataactaatacggctataaatagtttgatagataagatgctttctggttttgcaggactttcacatattactatgatgattgcattactaatattattaatttctttaaaaaaagaatttacagattaaggagaaatacatttatatgtcaatattactgattatggcaattattttcatgacgctagcattggttttttatacaatcggtgtttttgctgaaaaaaagagtggcagtttactaaaatggcatgctttgatattttggcttggctttatttgtgatacatcaggaacgaatattatgggacaaatatcagggcacaattttaattttaatctccacggcattactggatcaattgctttacttttaatggcttttcatgcagtttgggcaacagtaatactaattaagaaaaatgatcgtgctaaaaaaacttttcataaatttagtattatcgtttggtcaatatggttgattccttatataattggtatttatattggaatgaacggttaaaagaagagagactgtcatgtttcccttcttttaacttatatataaaaatacaagcattcctaaatattcaaaaatcattttccatcaataatagttaaaaaagtaacactacccaataatcaatggaggtaatattcttttaaaactgtatttctaatatcaattcttccaatagcataattagctattttttattccttaagctttataaattgatacaacaatgtatccattgcgagtccaactccaattaatagtatttcaacaaataatgtcttgcctttttccttttcctcggtatatattaaaggatatgtccttcctacaactacaaaattttctatataaaataacaggctcatatgcgtctcaatctttaagatttgtcagactctcagaataaacagtctattaacaaatcatacctacaggcgaaatactctttcataaaatatattcttataataactttgtatattatcaattatatccatcttaaatatcaaaaaaatacatgcaacactataagttataaatatttactagcttctttaatacttagcttattcattagagtacgatatttaataataaagtttattacccataccaaattagttctagaataatttcttaaactccagccaattgctttattaataaaaaactcatcacttccaaaactattaacaattttttgctccagcaagtttgtatttgtcttatctttgcgctagggtgagggaattccataaaatgtaaataaatctctcatatattttgacgttttatctgcttttttaatatcttgttgtttttcaaataacttcttttatcattgtatatttattcataatatttcctttaatagtataaacacgtgttaaccacattgttaataatgtatttagtctattcttcaacgccaatgatttcaaaaatatcgttcttataataagatttatctaggtgatacttctatctaaatatgcttcaataaatttttttgaaggggaataaatattattaggcagcttttctatttcaaaccagcaccactcatcttgtttatctggttccatagcttttaaatctccatcgtaatttttagcaataatatgtatcgttacatagtgcttatttaattgaatatcatcgactacattaaaaacttctatctgtgagatatttaaattagtttcttctttaacttctctaatcgctccttcaaaaatagtttcatgatactcttgttttccacctggtagacaccatgtgtccggttcatagatgccaccagtatcaaccccatcttttatccgatgtcctaaaagaatctgattattcttgattaacaaaacacctattcccactttaatgattttctccatattatttcctcatttctaattggatttatctaactgtactcttaagcttctcatgacgagtttgatacattgtatttttaagttttttaattatttcaagatcatcagatttataaaaagtgattttttcttcattagtgaattgaataagttcatcttttcctaaaatctttgctaaattaacaactaatgcattcaaggctttttgattataataaaagataattacttttgcttttttacaatgaatcagttttctaattacatctccatctacaatatctaaggaatgaccaaaaaaatagatataaaattgttcattgtcatttaaccatttagtgtagttattacctgtttttttaacaatcctttgataatacttttgaaattcaagataatcatacttatcattatcggtgacatttttaatttctgagccaattccaaaaaccatattattttcttcttttatcctatctttagcagcaaatccatgaatataatgaactgtatttgtttcttttttatacattcttgtgtacgtatcagtataattaaaagaaatgagtttagttactggtaaatatttaaataattcaattttcttggttttagtatttaaaaatcgtgttaaatatatttccaataaccatgttaattcttccaattctcgatataaatgtttctttgtgagttctatctgatgctgaaaatcggtattatttccacgttcttctgttacaatcttaaataattcaattaaattactagaatatcgtgaagcgagcatagtttcttctcgagtatgccagttaagattatttgaaatatatgataatatctctatttgtttagcaatgacatattcaagatctgaccacttatccccaatcatacttttattttttaagacatatgtaagccaataattttctttacatgctttgataaattgagaagtttcagatgttggagttaagtttgaaaaatattttattgctttggcagaaaccgacttttctttaaaaaccttatctaatttttcttttaatatatcattatattcattttgatatatgaattgattatccttaaatccttgataaaccgttgcaatagtcttacaaaaatttataaaatcttcgtaacgagtattaaaaccatgtgcaatatcaaagccgttaccaattactaatatattctccatcaccatactcccccttatcaatcaaaattttaatttactaattattatctaactattttttactgtcaactattaaataaacctttataaacagatagactcagtgctaggcattttcacctttaacaatgataagataataaaaaaattgcaataaaaataaaataaatatcttcttattttgaattcttttgttctatcattaatattaatttgattaggcatattgatttagagtcattgaacaagggctaactttccaatgcttaagcagtaaccacgttttcaaattgtgtataaagttctggtagtgcttctaaatcctcattctttgcttctttaagcatcttactatcttcttggattggatcacaataatattacattatacttttatattatagcttaaacctaaagctattactaatattattagtaatacgtatttaatccataaataaaaaaatcaaaaatattaaacacttttgatttttctttccttataataataaattttatcatgatcatttatttcccgtttaattgtgcatggttgcccataagcaacaacatttttaggaatatcttttgttacaatacttccagcaccaataacactattatcaccaattgtaatacctggtaaaataattgttccagcaccaatccatacattttcaccaatataaactggaagattgaattgatatgcttcttttcttaattccggtaaaattgggtgagttccagtaataattgtaacatttggacccatcatagtataatcaccaacataaatctcaacatcatctactaaagttagattgaaattggcatatactcctttaccaaaatgtacatacttcccaccccaattagcatgaaatggtggttcaatatgacatccatcaccaatcactgcaaacatttcttttagcaatcccttacgtttttgtttttctgaaggtcttgttacattataatcatataatttttctacacactgtagttgttcttttagaatttccgcatcatttgaacgataaagtcaccctcattcattcgttttctttcatcattaaagcccatggtttaactcccttacatttatatctcaaattttaaatccaattatattataatatagctttaatcaatgtaatagtatctaatgtttgataatgctatcaaaatgttaactataaataatttgttcagtgatttaatcactatttcttatcaataatattttctttccccttattcatcgtttcagaagaaaagaatgtaccatcaagcttaacgatatctgaatctttttatattcctaaaaaagaatagccacttccaaaatcatccatagagtagttgaatccagcctaatgaattttctcaataattttactaaaaacttctagttaggcaaagaccattgtttcagtcaattctaattcaagatatttagttgggaatctatggtacatggccatctcttccttcttattaccgcctaaattaagaaagcgcttttatgactatataatcatatatgcccctttaactaatggtaaagctataaaagtatttctcattgacattgaactacatttattttaatcttcctatataaacaaccgtcttattctccattactaactgtccgttattgctatatttatcaaatacattttctaaggcagcaatgtattcaaaataattctgatcagttttttttaaagaatatgaacctgagatacagcgcttaataaaacccttctggtcaaaaaataaaggatttggaaactccatacgcttatagtgcatatcaaaaaattcctttattctttcatcatcgcgtttaatcccgccattaaaaccaacaaagttttggcaatactgtttataaatttgaaagcactcttgattcaatggtgactccatttctcgtacattccaaaccaatgctacccgcccttctaattttaagattctcttacattctcttttaaactcatgaacattgaaccaatgaaatgcctgagcagatataataaaatcaacagaactagtatctaacgtagtattaccagcagttccattgatagcatgcaatttattatatttatttaatttattgactaattcatttctcatatctttattaggttcgacacaaaaaaccttactacctttttctaataacagctttgaaaatttaccagttccagcacctatatctgcgattatcgatgttgatttaaaaccatagtcagtatataacttttctattaatatagtcgggtactccggtctaccatcctcataaagatttgctaggccatcgaattttattgtactatccatattattaatactcctttattgataagtctttttttatcagttattaatcttgttgcttcttcaatactttgcattccaccacaacctctcgtaataacaccagataaagccatgtcatctttaataagttcttcttgcacctttttagttaaattaacaatttcttgagcccgttactagacaattttctttcatctgttaaataaatgctgtgattgttgctcttaaatagttttacacctaattcttcttccaactgcatcaaccaccatagcaatatcagctaaattgaatatataatttagacgctttagtcatattttcttctcttacggctactaaaaatatgttaaaatcaaataaacataaactatctccaataataatatattttcattatgccatatcaaaaatttattaacaatactaacattaagcaataaacacaacgatcaaagcataaactactaaagtgattatcatattcaaagaaatgattgccgaagcaaaaccgcaatcatcattacttttatataaaggggaaatctgcattggaatagcaaaaccagtaggactcataaaataaatcaaaactgcaatcataaaaaccttatcaatcataagccctggaaagaagataaagaaaccaataatcactagaatataaaaaataattctagcaactaacaattttaacactgctcccaatatttccatattgatattcaaatcatacccaatgataaataaaattacgcctacaatcggtgctgttacttgggtgattgtattactgtatattcctaaatatgaactgtttgataaaaaattatatgtacctaataaattaagtcctaaccccaaaataactgcaattacaaatgaattagttagaattgttttaataagttccctaatccttgtttcaccagcacccgctcttgcaaccataattggaataattacaaaagccataaaaacacctgctaaatcaaatattacagtattacttgaagcccctacaattgatagatacaagggcaaagctacattaccaccttcacatgtcgttaacaagtaaggtgaaatatgagcaaatttttccccagtaaaatttattataaatcttccaataaacaaaataacacaatatgcaataaacacatataaaacaataaaaatagctgaagtctctagcttagaagtaaaaaggatattaaaaatcattattggaaataaaatattaaatactattttatttgctccatctttttgacttggtgtaataaaacctcttattcttgaaaaagttcctattccaatcataaatataacaggaaatattgttgttactgctctcatttaaactcctcctctaatattttcttgcatttaatttaacatcatattttatttacttaaatacattaaagtctatttagaagaggttttacaaatcaatccttaaaaaagaatatttttgtaaaaaggatttacattttaaataaaaatattgttcctaaaggaacaatattttcataaacctattatttttcattaaataattcagacttcttttcaagaatttgagcaacaactaaacaagccggacaatcgcaatatttagccccgttagctttaatttctttagcatggctttcaatatttttagcattttcttcaccaaaataagctttaccattgtcagaaccagcaaacctaattaaattatcaattggcataatatcttcttctaattcagcgatatatttcttagtctcagccatttcgctttctgttccaatcgcatttaaccatgcttgggcagcttcctttgtttcattactgcaagttggagcaacaatcaattcacgtgtcttttcagcaatataatttaatacttctttgttcataaactacattccttctttcctataatatttaaatatattatactatattcatttatttgttacaatttattgcataaattatatatttcttacatggtaactcaaggttattatattcaaatctaaaaaatacaatcaaaattaataaaacagtaatctccaatccctatattggtacccttgactataataaaatggagattttataacttcatctttaataagattcacaaaatcattcataataaatgcctccatttttaagtttaattaacttataatgctgtcccttttttaggagtaaacagcgctcccatatccgctccttctaattgaagcagtgcaatctttttttcaagaccaccagcataaccagttaagtttccgttacttccaacgactcgatgacaaggaataatgattgagatcggattgtgtccaactgcaccgccaacagcctgtgctgacattgtttttaaacctttttgctttgctaaaacggctgaaatgtcgccatagctgagggtttgtccatatggtatttctagcaatatttgccatacagcaagacgaaattcacttgcttgaagagccaaaagaggaataaaatctggcttttgaccattaaaatataagttaagccattcctttgtttgtttaaatactggtaactctacgttcttatattcttttgataaattagcgccaaaatatttttgaccatcaaaccatagacctgttaatgcttcaccattactagctaatgttattgctcctaacggtgaagtatatttagatatgtattgcatatttcctccttataaataataattgttaaatattaaatgtttattagtaatatttattatagcacagataataaaattattttaagtttattttccataacaaaaaatggctaatcactaagatatagccaaattaaatattttattgaataattttaatatcttctttaagaagatcataacgcaatccttttaaaattaacatataatacttatcatttatactttcaaatatagtgttcttactaatttctagttgatcgccaactttaaattctaataatcctaatttataagacattttaaactctattttcattttcgcacctctatactggaactcagtataccattaatattacttcaaaacaacaataagacatcataagtatgctactaatatttattattgttctttttataattctttatttaactatatatatcttcttacttgattcatatattgttcataagcaattccaaacttgctgatacaccattgctcctctgaaagaataacccaatgtatagagatttgaaatagtaataaaattataaataagattattgattgtgttaataatacggttcttaaaaagaaaataaaatatgacatatacattggatttcgagagaaacggtaaatctcgttagtatttaagccatcatttcttggataaaaaatctttaaccaaaacaatgcacattcccaatcctaacaaataaaccagtagacctaaacaaaactgccaagataaatcaattattactgataagaaaaaatatataaatattccgatattggccatctgataaattacataagctattttctcattgccttgcagtggagcaaaatatccagcccgtttgattgcaccttcgttaataaatgctattaataaaaaaggaataagtaaaataaatgcattcattttgtttcccctatttctaatctaactacccctataattggaaacatgatcatcattacctcttagagcaaccatatgtacaagtgtatttatcaccaatttcttcaccattacagcaataatgttctgctttattcccacgtaaaaactgttacttcaattgtaaattcatattcttcattataccattttttcacaatcagtcgcccgcttttattaggttatctaattttactataattatagatttagaacaattgaaatcaatttactcgtcataaattataaaaaaacagacttcttttaggaaatctgtttagtaattatttttatcatggctattttgacaaacgaactatattttctatatgtgttgtgtgaggaaacatatcaacaggctgacagacatcagcatgatacccaaattcttgaagatacttgatatcacgtgcttgagtagctacatcacaagaaatataaattattttcttgggttctgcttgaatcaaattatccaaaaattctgttgaacaccccttacgtggtggatcaacaaagacaacatctaaatgctgatcttgattaactagttctagcatatatttaccagcatcactacatttaaattcagcattactaatattatttaaaactgcattattttttgcatcatcaattgccgtttcaacgatttcaacaccatacactttttttacgtatttggctactgataatgtaattgttccaattccacaatatgcgtctaaaactatgtcttctttagataaaccagcaaattcaattgcttttgaatacaatttctctacttggattggattaacttgataaaaagattttaaagaaattttatatttattacctaataaagtatcataaatatatccattaccaaacaaaatgacttcttgttcacctaaaattacattatcagtgcgatgattaatattttgaataactgttttaatcattggaaattcttttgtaattatttccactaatttatctatatctttaattttattacgataactaattagtactaacattacttcgtctgtatgataaccgtgtttagtcaaaatatgcttaatattaccttgatgagctaacttatcatatgggtaaattttaaactcttccattaattctttaactcgattagttatctgatttgataattcattttgaatataacagttttcacatgggatgatttcattagacttttgtttatagaaaccagttactaaatgatttcctttaactccaactggcatttgaactttattgcgataatgccacggtttttccatcataatacaatcatttaccgccactttacaattcccgattctttctaaacaatctttgacccgttttgttttataaatcatctgtccttgaggattaagatgttgtaactgacagcctccgcatggtctaaagacagagcatttgggatcaatacgatattttgaagtaacttctaattcaattaaacgtgcaattccgtaattctttaatacctttattacttttagccgtcctctttcacccgtaagcataccttttacaaagtatgtaaagttatcaatcttaacaactccttgaccatcgtgagttaaatctgtgcattcaccataaaaataatcattttttttcatttagtcctcctcataaataaagacgagccatgctcgtctattgattagcgttcgtattagccgcacgatcagttgcagcttgatcaactacattagctccagtaaaagtaatatcatcactatttggatgtttagtaccaaatatagggaaattagtatcaccattgctcgttagaacaaactctacgttgtattgtccacggccattagcagtagtaaataaattactatatgctctaccttcttccttattttcacctaaagtatcatctaatgtgtgtaaggcgtttgttgccagttgtttagcagtatctgaagaagtattatcaacaaaattcatactaattttaacaattcgacaatctacttcaatattgatactattaacgcttgggtctgctttgattgcatcttcaactcctgtaaatttacttttgtcaattgcaattaaagaagcacaacgatcaccataaactggtccatcatttcctccagcaacaaatacatagatgacgaacacaataattattgatagaaaagcaattaatgcaatttgccatttcttaattttaaacttgcgtttcttcttgtttttcattgatttatctcccccgttatcagtaggataagctttggcatctaaaccatcttcatcagcaaagacattgtcgtttgaaggtttatcattattagttattgatgaatttttaagatcatcttttgatagatcaattgtatcatctacttcatcatcaaaactaaatctttttctttgagacatatttatatcctccttcaaccattgtaccaaatatagaattatttgtacattatgaaattctttgtttcaatagttcaattagtaatttacttgtaagaccaggattagcttgaccaccggtttttttcataatttgtccaactaagaatcccacagctcgatctttaccattgctataatcttcaattgattgaggattattatcaagaacttcattaataattttagttaattcttccggtgaagaaatttgtttcatattattttcttcaataataatttctggatctttaccttcattcatcaagatttcaaacactttctttccttgtttacttgagattgttccatcttgaatataattgatcatttttgctaaatactcaggagttatattagtatctgtaataatcaaattatttttatttaaatatgcttgtacctcgcctaataaccagttagatgcaattttataatgcttagtataagcaactgtcgcatcaaagaaatccgaaacttctttagtttgaacaagtatcaatgcatcagttttaggaattttgtattcatttatgtatcgagctactcgtgattctggcatctctggaattctttcaataatcccttcaacccattgatgattcaatcgaataggtaaaatatttggttctgggtaatatttgtaatctactgcatcacctttagctctcattactacagtttctttactatcttcatcataacggcgtgtttcttggagtacctcaccaccactaattaagactttctcttgtcgagcaacttcaaattcaattgctttttgtacatttgaaattgaatttaaatttttaatttctgttcttgtaccaaatttttcactaccatatggtcgaattgatacattgacatcgcatctcattgagccttcttccattttagcatcactaacttctgtaaataagaaaatttgtcttaatctttctaaataggcagctgctgccgcaccactgcggatcgtcggtttagtaacaatttcaattaacggaataccagctcggttataatcaattaatgaataatcgtcaaagtgtaattgttttgcagtatcttcttccatatgtaatctttcaatttcaattacttgtgtttgaccatttacctcaatcttcattgttccatttcgcccaattgggaaacgatcttgcgtaatttggaatccttttggtaaatctgaatagtaataatttttacgatcaaattgtaccagttcatctatttccatatttaaagcactacatacccgtatcgcaaattcaacaccagatttatttagtaccggcattgcccctgtcatccccatatcgacgatattggcatttgtatttggtgcctcaccaaatgttactggggccccagaaaacattttcgattttgttttaagttcacaatgaacttctaatccaataacagtttcaaaattcattctctctacccctctcttgaatactgattttcaaatcctaatgcttgttctaaagcataagcgacatttaatactgtttgttcttcaaataaacgtcccatcagatttatagcaatcggcattccttcactaaaaccagacggaattgaaatacttggcgtcccagcaaaatttcctaaagctaaatgattttctaaaatcaagtattcatctgataggcgatcatcatttgcttcatcaagttttggggctacactaccaccattaggagtcaaaataatatcataattatcataaattttatttaattcttctacaatcaaacgacgtactcgttgagcttttctaaacatccgttcctgattttctgtagctaaggctaaatttcctaaaataaaacgacgtttaatatgagcaccaaatccatcagttcgagaattaatcattacttcgtcagttgatgaaccaggttgccgatcaccatacttaattccatctaagcacgaatgattacttgttgcttcactattagcgataatcgtgtaagttggtaaaattgctttagctagatgaactggaatttctacctcttcgacacatgcccctaattgttttaaggttgcaactacatggttgaaattatttttaatatcatcatttctaatttcattactaactgtttttaaaacagcaattttcatattcctaatatcactattcaattcttttaaataatgtggtactggccgtgtgcttgaagtcatatctctttcatcacgaccagctaatgcttcagttacaattgccatatcacgaacatttcgagtaaaagcacctacgtgatctaaacttgaagcataaggaataacaccaaatcttgaaattcttccccaagttggcttgaaaccaactacaccacagaatccagccggtttacgaattgaatctccggtatcactacctaaggcaaatggaacaaccccactaccaacaagtgctgcactgccacctgatgatcctcccgctatccttgatgaatcccacggattatatacaggcccagttagagcggatttgttagtaccacccattgctaactcatccatacttgatttaccaattaaactaacaccttcattatataatttttcaacaaccgcagcatcgtaaactggtacataatcctctagcattttacttgaagctgtcgttttaattcctttagtattgtaattatctttaaatactccaggaatccctttcaatatttcttcatcagatattttaagttctttaatattatccattgcttgagttttagtgattgtaacaaatgcatttaagcgattttgttgaaattccacttctttaaataaatcataataatattcatttaaatctatttcttgattaacgattaaattatgcaattcttcaattgaataaactttcattatcccaccacctttggtactttaatttgattatcttgaacactcttagcattttttaaaacatcttctcggcttattacatcaatcggttcatcatcacgtaaaaagcatgtctcaatttcataaggatatgctaatggtgccttaccatcagtgtctattttctctaatacggcaacgtgattcataaaaatctcatattcttctactaactctggcatttctgcatcagtaatattaaacattgttttcaatccaagcttttttaacatttcttctttattttccataaattacctcctaatacaacaagatactcttcgcatcttcacctttatctttaacaatcaatgcctctagttgatcttgtgaactaactaatactttaatatcaaaaccactaaattgagtatttaattcatcagctgcagtagaaatcaaataaagcaattcagtatatgttttaatatttacttttaaatttattttcattgactgaatctgaccatttttataacgaccatagccaattacaccaactgcctcagttgcagcttttttcatattacttttaaaaatttcaaattgtgatgctgtatcttcatcagcagcagttgcttctgtacttgtaaacatataatttttgtaatctaatgtttcaatatttcccacactgccatcacaataactttttaaaatataacgaccattaatatcactttcgttagtattagtcgcataataaacacaaatattagcaggaatatcttttaagtcttttttactctgtaaatatttgtataatttactaattgcttcacgcccaaaatcaacaactaacgattcatctaatgaggtgtctaaacgttcatttttttcatcacgaggatctagtacgattgctaatgatagaccctttaagacatattcagatccgtttttttcataataatcttgttcatgcactgtacttaccatgattggatttgcaactccgccaatagtagttccccgctgtgcttgtaaggtataaggatatttactagtatcctctgagcgttttaataattgattcatatcatccgttttaagatattgcccttcagacatataataatcattagttgagaaatgatcagtagataaaatctgtaattctcgtccaattgtttgaaaatccatagtatttccaaaagcagtataataatcttctcgacttaaattcgtattaaaattaactactcgataaaatgaatcatctaaactatcggtagtggatacatcatttgctgtttgattttcaacggtctctttagcatcactacaaccgctcagcaccaatgctatcgctaataaagccactatttttttcattctagtgttcctcctttatacagtgcattataacactattttagctacttcaccatctctagtaaagtttcttcactaattacattaattcccaaattttgggccttggtaagtttacttcccgcattttcaccagctaataagtaatccgtttttttagacaccgaacctgagactttaccgccatgcttctcaatcaattcacttgcggctttccttgaaagagttggtaatgtccctgttacgacaaatgttttgccatcaaaacgttcatcgccatcttgagcttcgataatattcatattaactccatactcttttaaacgttgaacaactgcctgattatcaggattcttaaagtaatttataattgccatagcactaatatcaccaatatcattgacttcaatcaactgagcataactagctttcatcaaattatcaatacttttaaattttttcattaaacttttagcagcagattttcccacattactaatccccaaactcgttagcaatttaattgcatcattatttttactaccttcaattgcatttaataaattatctgtacttttaactaaaccaataatttttttatcaagtaattcctgacgtttatcaattaaaccataaatatcacttaaatcttttaaataaccatgatccactaatgtttctacataagcaaagccaaaacctttaatatccatagcatcacgtccaacaaagttaacaatatttctaactaacttacttggacagctatgattcgtgcattttatatccgcattatcaccttcacgtacagctggagctccacagactggacaagtattgccaattacatatggagcactatcagcggggcgtttttctttaacgactcctttaaccttgggaattatctcaccagatttataaacaacgatcgtatcaccaatccgcacatctagatcatcgataaaatcctgattatgtaaagttgctcgagatacagtcgttccacataaacgaattggttcaaaaatggctgttggagttattcttccagttctacctactgacaattcgattgctaataattttgtttctttttcttcaggcggatatttataagctactgcccaacgaggtactttagctgttgctccgagtttttgtcgatcagcaaaactatcgattttaacaacagcaccatcaatatcatatccaagtttatcacgattttcaccaatcgcctcaattgcctcccaaacctctttagctgttttacaaattttataatcttcaatgattttaattccttgccgttttaaatattcatatccttcactgtggcttgtaaattctctgcctttagcatcttgaatattaaaaacaaacattgataaatttctctctttagtaattgaactatcaagctgtcttaacgttccagcagcgcagttgcgaggattcgcaaaaagtttcttccctttaatttcctgaatttcattaactttatcaaatgcttcattggtcatatagacttcaccacggacttcaagatattcaatcggttcttttaaaatattttttacatccttgattactttagcattaacagtaacatcttcaccttgtaagacaccatcaccacgagtaacagcaacatcaagcttaccattgacatagcgcaatgccattgacaacccatcaatcttgtattcaaccacaaaagtcggatctaccagttgttcttgcatatccgcaacaaatgcatctacatcttccttagaaaatacatcctgcaatgataacatcggcacattatgacgtacgagtacaccagcttcacgctttgcactaccacctactttttgagtcggtgaatcactagtaatatattcagggtgtttttgttctaatccttttaattcctgcatcatcatatcgtattcataatcagtaatctctggattatcttgattgtaataacgatcattatgatataaaattgttgcttttagttccttatatctacttaaatcatccattatctcactcctaatttaatcttaactattataccaaaatacgtataactataaaacaaaaaatgtgcgtttagcacattaatttgttagtttctttaatgctttgtgatttgccatcaaagtctttaaaccagcaggcaattcaaaagctatatctaaagtattaccattgactttaacaacaacacctttaccaaaagtatcatgtaaaacaaagtccccatttgaccagtcagtcacttcattattccctactaattcttctttagttggagctgtattaataaagtttgctgttttaaatcgtggctttgttcctacatgcttaatcccctcactcccgatttcatcaataaagcgacttgaaattttaggagaatctgttacaaaactaaagccttcactatctgtcaaaaacaattgttttcttgctcgagtaaaagcaacataagccaaacgccgctcttcctctaatccttcatctgattcgcttaatgctctgaaacttgggaaaatcccttccgataaacctaaaacaaaaacgtaatcaaactctagacctttagccatatgaattgacatcagactgacatattgtccatcatccaaattatcattatctgtatataatgaaatttcttgtaaataattttcaattgttgcaatatcaggattttgattttgaaattcataaattgaccgttgtaactcatgaatattatcaattcgattatcttctaaatcctttttcaacatatcaatatatccaacatcgttcatcaaattttcaaacatttcatgaagcggcagacttgactgttttgctgtttcaacagctttaaccaatgtgattatttcttttttggcttttgatgacagcttaatttgatcactaaatagtgtcaacgcctcatacaaactaacctgattattcaaagctactaattgaatattttctaatgttttttttccaattccccgagcaggaacattgataattcgttcgaatgcaagatcttcatcattacatactaactgcagatagctcaatgcatctttaacttcttttcgactaaagaatttcaaaccaccaaaaatccggtaatctattccatgactaatcatactctgttcaattgttcgagataaataattagcacgatataaaattgcaaaatcgcgataattgactccgtcaacttcactaattattttttcaatctggctacaaatataatctgcttcttcctgttcactctttcccatataatgaataacttcactaccaccagtagcctcagtataaaggtctttttctaatcgatttcgatttttacgaattaagctattggaaatatttaaaatatttcccgtagagcgataattttggtctaaaatcactgttttacaaggtttgaaatctttatcaaaatcaagaatataattaacattagcccctctaaatgaatagatggtttgatcaggatcgcctacaacacaagtaattgcgtcttgtgacatcaatttaactaaacgatattcaatattgccaacatcttgaaattcatcaacatggatgtattgaaatttatgctgccatttttctaatacatctgggtaattttcaaaaatatatactgcttttaataaaagatcatcaaaatcaagcataaaatgattttcttgatattcaagatattctttatatactttagctttctttatttcaccttgaaactgacctgctaattccattgctcgttcaggatcaatattagccattttataatttgaaatggatgcaatcatacttttaatactgattgtttttgcatcaatatctaaattattataaatttttttaattaatgctttttgatcttcttcatccataatcataaaattacttggataattaatcacattaatatgtcgtcttaatattcggacacataatgaatgaattgtgcaaactaacgaacctaatgcatgaggtcctaataatgatgtaattcgttctttcatctcgtttgccgctttattagtaaaagtaatagctagaatttttcgcgggtcaacaccgatttcatcaatcaaataagcaattcgatacgttaccacccgtgtttttccagatcctgctccagcaattattctcaaatgactatcaagatatgttgctgcttctttttgatttttatttaataattcatctaattccatctaatcaccaccaccgatatattatatatgatattaaatataaaagatatataaaatattatttctctcaagatattttttctttaacacctaaaaatatcctttaaaaataaagtacagttatttgtccaaataactgtacttctactttaattatttactatgtacttatgataataacgatttaacaaacaatcaataaagaacaataacttatattttccaatactttcactatcatgcccacctaatccaattacttgtgtaaattgttctgaaaatttaatatgaacattttgagttatcagaacatttttagctaatgaaataattgctggaatagtgattgctttttccattaataatgtcccttctaatgataaaaaaatacagagatcatctcgacggatttgcttagcaacctccatttgatgctctttacgaggataaaattcaataaacttacccgttgttaaaattgcacgttgcataatgcagccaagatcgccaggaatatgagttgcaaaaataaaaattcttttagcgttatgaatatactcacacaactgttcaatttcttgatcaattgatgtttcttgcattcttactaaactttcagaaattgcttgagcatagtcaacacaattaatttttttagtcgctcgagtatctatgatcatttcatctgtttcttcttgaatcccaatacagtcagctttaaaatcattaaaatttgcataacctaaatactgcgaaaaacgactaatacttgattgtgatgtataacaaatatcagcaaaatcttgcaatgaagtccgtttttttattttatcaatattttttaaaatgcatctagcgatatttatatttgtatcatcgctatctggtgatgtgtttacaatattttgcagtttataaataaaaccagccattgtctgttatcgaggaatctcctcgatatcctcctttcccgtactacttcaaaattctttggcttttattgttcccctcttattcataaaactataacagcactaacccatgccattattataacactacttttcaagaagtgaaaagatattctatttttgaaaatctattcaaaaattaaaaatcatttgcaattttctatattgtaacatttcctcatgccctttacaatttagttagatacagaaatgtatagacaaatcatcatattaatcaggaggtgttatcgcaaataactgctatattttatttattatcatatcatgaaagggaaagagatatatgaaaaagaaaaagagattattaccgattgtcatggcctcacttatggctatgtcgatcaacgtcggtccacttaaagctgccgatgctccactaattactaatccgtcttttgaacacgaaattgataaaaatgaagttcaactctacaaagctgtcagaactgacgaaaaagcttttgacggaaaatactctatcaaagttgggaatcctaaacctgaaaatccttctgaagttcctatctggcgttataattatggtaaaggtagtgttaatgttattttccataacgttgagcctaacactacatacaagattactacccattactggaatgaatccggagtaaagatgtctaccggagttcttgatattgaaggtaagcatactacgtctccttggcagcttgcttctaatatccaaactaaccaaaaggtcagcactgagtggcagactaatgaacatactatcactactggtcctagaactaatgaaatttacggttttgcctatatggaatggactggtaatgacttaggttctggagttttctatatcgatgatttcaaaattgaaaaagtagaaaacaaaacagttgaagagaaagcttctatcaactatgatgcagacttctctgaattcccagaaactgtccctgctgttcagaattttgaaaaaaatggaaatgaaatttataaattaaatacagctaagcaagttttttcaactgatgaattcagtaaagctaagacccaatatctagccgacagtatggttaaaaaagggctgatcaaagactatacgatcaaaactgttactgatgcctcacaaggtgaaggtattgttttagttaaacagccaatcacttttgaacttcctgcagctgtaacaacaagcaaaatcgatgcctatcaaatcgatatcgatcaagacaaaactgtcatccattctgactacattcaaggtattcaaaatggtgcaatgactatattgcaggccttcgctcaaagaaaaagccttcctgctggttctgttcaagattacagtgatcaagttgttcgtgggcttcaggtcgactctggaagaagatactattcaattcaatggttaaaagatcagattgaacaaatggcatattacaaacagaatatcttacagctgagacttaaagacaacgagggtattcgttatgattcgaaaattgctgctgattttgttgaccgtaaaggtggattttggactcaggaagaagttgatgaattagtcagctatgcagctaaattcaatatcgaagctattcctgaaatcgacttcccaggtcacgctgaacaagaagcaaatttccatagcggatggtgcattcctggttcaaccaaagcattagacttttctaaacaggaagttcgtgaatatatgatctctgtttataaagaagcagcagatttcttccatgctaaaacgattcatatcggtggtgatgaatatttccaaagtggttatacaactgccggtaaaacagttttacaggaatgggcacgtcaagtgacaggaaatgaagctgcgacagaccatgatgctatcaaacttttcttcaatgaagcgggagacgaactaatcaaacaaaacttaaaagtactagtatggaatgacaacatctttgatttaggaggaatagtaccattagacagccgtctaattgttgatttctgggctggaggaatgtacggatcaatcaaagccagtactacagctaatgctggatatacaatcatgtcaagttcttcatcaaactatcatgatttatggccacaacaaggacagagcaaactagaccgtccattaccaaaacggacatatgaagaatttacaagatatcattattcaaaatcatcatatcattatggaaatgatgaagtattaacagaaaatcttgacaagtcattaggacaagtattcccaatttgggatgatgcccacgggtatgtaccagaatatattttgactaggacactattcccacgttatgctggatttgcattaaaaacatggggagcagaatatcaaaaggaaatggattacgaaagctttgaaagactgatgtatacacttggatcaccacgtgatgatttatttacacaatcaaaaatcaactacaacaagactgatctagatctagtaataaataaaatcgaaaccgctctggctgacaaaactacaacaaatactgcagttcaagaaaatattgataatttaaatgctatgatcagtgatgttaaagcaaaccctgctaattatcaaaaagatagtttctacacagatattatcaatgatttgatttataattacgaaaatgttgagtacgtagtagttaaaaagaatcttttaaatattgcaattgaggaagcacttaaagttactgaagcagaattaaatactattgttcctgctgtagttacagaatttaaagccgctctagcagaagctcaacagatcaatggaacttctttagctacgcaagaagaagtaaatgcatcgtttgaccgtttaagtgacgtaatgcaaaaattatctttcaaaaaaggtgataaaactgatttagaaaatttaattaaaaaaattgctaaactaaatgctgaagattatctaacaagcacttggaatgcaatgttacctgttttagatgaagctaaagttgttgttaataatcaaaatgctttagaaccagaagttcaagaagcgcacgataaattagtaagagccttcttacagctaagactaaaaccaaataaagatgcccttaacgaattaattaataaagctgaatcattgaatagtgcagaatacactagtgaaagctgggcagcattagctaatattcttattgatgtaaaagctgttgcagccaatgaagttgccactgttaccgaaattgaaaccgcatatgacaacttacaaaatgccatcaataatttagttaaagttactccagcagagccaactacacctaacactccagatgctaataaaaaagacgatgttaaacaaggtaacgtcaaaactggtgataatacaaatatcgctctatacacttcattatttattatgggtgcgttagtattaccattagtattaaaaaagaaaagacataactaaaacactcaaaaaatctcactatgtttagtgaggttttttctatgttcaatacttggctcatttttcaaatattgaatataatttatcatcttgtaaacctcaataataggctatacaatttaattaagtgcaagcatatataaacaaaccattatattaatcagaaaatattatttaaatgatcttaatgatttgatttataattatgaaaacgttgaccctaataactatattcatactaaaaatgaaacttctactataaaaccatttgatttggaataaataactgctaaaattagagatagcaataatttattatatttaaatttactaaaaactgccttatttagtttagtaatactcgataaaaaagaaaaacgatacaataaataaaaatactagagtttgtattaaaataaactctagtatttttattaaaatttatgtgaacgtccaactaaatcatttatatcattaataccaatttgttctaataatggttctaaatcattaataattttttcacatacatatggatcaattaaattctgacaaccaattgcaacagcacttgcaccagccgacatcatttcgataacatcacgggcattttgaatcccgcccataccaattactggtatctttactgcttgacttacttgataaaccattcttagagcaaccgggaaaattgcgggtccagaatatcctcccgtcttattagcaataattggttttcctgttttaaaatcaaagcgcatccctactaaagtattaatcatcgttataccatcagccccagccgcttcaactgctttagccattgctacaatatcagtaacatttggtgataatttaacataaactggaactttagaaacttccttaactcgacgtgttaaatcagctgccatttctggattagttccaaattgaattccaccactatggacattcgggcatgaaatattcaattctaaggctcctaccatgtcatgagtagaaatccttttagcagtttcgacataatcatcaggtgcactaccaccaatattagcaattactttatcattatatagcggtcttagtttttctaattcctcagccataacagcatcaacaccaggattttgcaaaccaattgcatttaacaaaccacttggtccttcagcaattcgaggtagagggttcccatagcgaggttctaacgtagttcctttaagcatcattgaaccaagaatattgatatcataaaactttgcgaactcatatccaaacccaaatgttccactcgctggaataatgggatttttcatttctaaaccaggtaaagatacttttaaattagccatttacaatcacctcgttactttctaagattggtccttcaacgcagattcttttatatggtctagttttaactttgcaagagcatcccatgcaggcaccaaagccacatcccatccgagcttcaaatgataattgcccattttctggataattaagtgctaaagcatctagcattggttctggtccacaagtataataattatcaaaagtcaaaccttcatttttaattacatcaacaaccgttccttttgttccggtgctgccatccattgttgcgacaaaaacattagaaaattcagcaaatttttcttgatagaaaacatcttttgcactgccaaaacctagtactgtcgttatctctattcctttggctgcaagctttttacctaaattatataggggtggtgttcctaatccaccaccaatcaataaagctttaccatccttaatggtaaatccattacctaacccaatcaaacaatctaaatagctgccgatttctttattttttaagattttagttccttctccaactactttaaaaacaatcacaatatgactatcatcataatcactgattgacatcggtcttcttaaataaggttgtaaactatcattgattttaatattgataaattggcccggagcactgatatatttagctccttcaccttctaaaatcatttcatatacatcatctgcaatatttttaatgcttgtaatcttcatcatcccatgtaagtttgccataatgcctcctatatttttgtaactttaccatctaaaacatgatactttaatgctccaaaacacttagtttcaagaaatggtgtattaattgattttgatttaatactttcttttgtaattacatattcttcttctaaatcaaaaacagcaagatttgcctttaacccaacttctagatcatgctcgattccaattatctttgctggatttatagacatacatgtcaaaactttttctaaagaaataagtccttttttaactaaatatgtatacattaagctaaatgcatgttgattcccaataattccaaatggagctttgtcgattggtttatttttttcttcaatcgtatgtggtgcatgatcagtagaaattacagttatacccccattattgattccttgaatcaatgccgctaaatcttctttacttcgaagcggtggattcattttataattgggattcatatccttaatattatcatcagttaaaattaaatggtgtggacatgcttcaccgctaactaatggatttgttttccgagcttcggttaatgccgctactgtttctttagttgatatatgacaaatatgataacgatttccgatttcacttgccaactttaaatcacgaacagcatgattaaattcagatgcattatttattccaactaaattatgttcttttgcataattaccatcgttgatacaagcacctggctgtaattcagcttcgtcttcacaatgagctacaataatactattattcgcttttgcagctttcattgccgtttccatcatcatagatgattgaactccacgaccatcatctgaaaaaccaactacaatttcttctttactattagcatcaaaatctactagttcttgacctcttaattcagtcgtaattgcactatatgtataagtatgtaccttcgcatcttttgctacccgcaaagcaaaatctttaattgtggctacatcatccatacatgggattgtattggccattgcaactagatgagtataaccaccgtatttagcagaattagtcccggttgcaatagtttctttgtgttcaaatccaggctctcttaaatgaacatgaatatcaacaaatccaggtgttaataagttaccttttaaatcaataatctcatcagcatccgttaattcttgagcgattgctgcaatacgatcattttcaatcaaaacatctaatttttggagtttattatgataaaatacattaccatttttgaataatattttagtcatttgttaacacccgatttaataatgccattcttacaaatacaccattttccatttgtctaaaaatacggctttgtgcacattcaacaatttcatcagctatttcaacattacggttaaatggtgctggatgcattataatcgccccttctttcattttatcaacacgtttttgattcaagccaaacatctgatgatattcatcagtcgttaatcgcatcaaatcatgatgacgttcatgttgtactcgtaataacatcacaatgtcaacttctggtaaaattttgtcaaaatcaacatagttatatccagcttcttcaaattcacgtggtccactagtatatacttccattcctaaacgctgcattatctcataattactatgagcgactcgagagtgaacgatatccccaacgattacaatcttcaacccttcaaaatgaccgaattcttcacgaattgtcattaaatctaaaagagattgacttggatgattcccagttccatcaccaccactgacaacaggaatcttaattctttcaattaaatcctcataatagttttccttgggatggcgaattacgacagcatcacacccaattgattcaaaaaacttaaccgtatcatataaagtttctcctttttgaacgcttgaatttgctgcttcaaaattttgagttcgacaacctaaattataagcagctttatcgaaactataatgcgttcttgttgatggttcaaaaaataagtttgcaactactttttgtcctttgaaatcaacttttttaccgtttttaaactcttcagcttcatccaaaatctgattaatttcttctgttgcaaaatcttttaatgtaaatatgttcataatcttcctccataaaaaatacctctaacgaggtataattgggaaataatattaattatacccagttgacatagtttttttctttttacatcataacaaaaataggttattttgacaattattttaccatataaaaagggaaatatttattccccttgatatttctttcgtaaagctgattcaacacatggtggtactagccctgcaacactgcggttatggctcaccatttctttaactgccgaagaagatataaatgaatgtgatggttttgtcattaaaaagaccatatctacttctttatctaaatattgattagaaaaagcaagttgtaattcgtattcaaaatccatagttgctctaattcctcgaacaataattcgagaaccaacatctttagcatattcaactgataatttatcagaagaatcaatgatcacattatcaaactgttgacatgccgcctttaataattcttttctttcatcaattgaaaagagtccttgtttattaggattaatacaaatcgttacatataaagtatcaaacattctgcttgctcgttcaataatatctaaatgtccatttgttacaggatcaaatgttcctgcataaaccgcaatatttttcttcatcgtcctatcctgccataaatttaaatacatttaaagctgtaatgccataatcattttttttgatcaaatctaattctttaaatggtttaaattctacttcctttaactcttctactactatcatacattcatcatttaacatttcatttacaattagaaattctaatatatcatctactaatccttttccataaggaggatctaataaaattaaatcaaatttaagtttttcattagcaaatcgttttaatgctttacgataatctaatttatatacatgagcattagctaatttcaacattgtaaaattttctttaattacttgaaatgctgcatactggttatcaacactatacaaatgttcataccctcttgataatgcttcaatacctagaccaccactaccagcaaataaatccagtactgctccaccatcaaagtatggtccaatgatattaaacagattttctttattacgatctgttgtcggtcttgtcaaatttgatttaacactttttaactgtctacttttatacttacctgcaattactctcataagccctcttataattgatatggtgataaatctaactcattagaaatacccccaaatactactttagttatttcatctaaaaaatcatttaaacgatgatacttacaataataatctaaaatatcttcattacttgcaattttcttctttaaatcacgaatttcatctttaatctcctgattatcaatatattgattatatttctttaattcatcatattgattcagtttattttgatattcatgcaataatgaatcaatctcctgattatgaagtttcttttcagcttcaacataatcaatatatcgctgatccagttttatttctgtaattaatttatctaatatctcttccatcttacctacatcatcatttctaccatattaattaacatggatacttgatcaatcttgtcaataaattgttgatttttaccatctttatattcttgaattaaatgctcgtattcttgaggataccgagataaaactatataccaattaggatgataacgaagataatatctaatttcttcattcatcataccattttctttccttagcaggctcttttttatctaaaaaagtactagcaacatttaaaactttttcaattgaacctaaactactcgataaagcatttaaatcaatattcttaattacttctagtaacatatttaaatcaaaaccactattacctgttttatatggtaaccaaaatttatcatctttaccatacataacaaaaatttcatataactgttgccaagtataacgtccattaagaacatcttgttttatactagggattgtttttaagaactctttaaattcatccataagatcacctaatatattatatgtatattagcctaatcggtgtcaaatttttgacgattatgttttgcaattattgcttgtgcgacaccaactgctacaaatgcagtaactgatgaagatccaccagcagaaattaacagtaatggtactccggtcataggaattaatccagatattccaccaaggttaatcaataaatgtaaaaagaaatatgaagcaattcccaacaaaataatccgtgatttattttctttaatttcctgtgaatattttaataacttaaaaataatgatacatgttggaataattattaagcctaaaccaatgatacctaattcttcatatataatagcaccaataaaatcgttttgtgactctggaatatatccaaatttttgggttgaatttcctaaaccaacaccaaaaagaccaccattattaaaagcaattaaagcatttgataattgcatacttgtatcataaggatcacttaatggtgctaaccatgtagaaattctccctaattggtaaccttttaatactgaagtcccaataattaaaaacaatactccacaaaccccaatgaacacccatacgattcgcttgtatttcttaaagtattgacgcggtgtcccaataaaacaaacaaaacaaatagttactaaaataacagttgttccaaaatctttttgcacaaagatcccaactccagcagcaattgctactaacatcattggcaggaaaacacattttaaaaacttttctttataaaaagcagatttcagctgttgtgttttaaatctaccttttactacaaaggctttatcactttcagttaaaaaataactcattatcagtatcattgcaactttcatgaactcagctggctgaatactaaatagagaaccaaatttaatccatgcatgagagcctttagtactaccaaaaaatatacagattatcattaaaaagattcctaataagtataatttcatcgatgcactataagtaatataccgagttttaaatactctggcaataaaaatcattaccccagccccagcaattacataaacactttgagtaatcatattttttaaagcataagtaaccccatgagaagtcacacttccaactgatgctgaaccaatcataattattccaaaaattgccaaaacaaaaacactagcataaatacctttatcgaccccacgacttttaaataatcgcttaatcttttctattcctgccaatttattcacctactcgaataaaatcattatttttggctgctttaacaacttgatatatagaataatgagaaatttcgtaaaattgtttgttcaattgcttttcttcacttttactatcaacaattgctttaaacttacgatatgcctgcataaattcttctttgctaataccttcttcataagctttttcaacagcattatataatgccattacatcaattatttcttctgttgaccatctatagtctaacggataattgtaatccatactaacacactccttaattgctttatattataacttaaaatttatcgattatctacaataacccaaacaaaagataaatattagaataggatatactaaaggaggcgataatatgaactgcggatttaactattctggatgtggatgtaattcatacaatccttttatcactaatccatttggatgtggtggatgcaacagctgtaacatttcaagcaatggatgcggttgtggttgcggtggtttcggttcttcaaactggtttgccattgtcttagttgtattcttattattaatcatttgtggaaattcaagaattagagtcggataaagtctttatttcacctcattttatgatataatactatcagaattaaaatgaggtgaacctatgataacaatgaaagatataattgatgaccataatgaaaagattcgtgaggtctcaaaagaagtagcattaccaatcacaaatgaagaacgcgaacttttattacaaatgcatgagtttcttgttaactctcaagaccctgaaacttctgaaaaatatgatttacgcccagctgtaggaattgcggctattcaattaggaattcctaaacgaatgactgctattcatgttttagattttgatgaagatggaaatgttattggggctgatgactatgctttagttaacccaaaaatcatttcacatactgaaaaacaatcttatttaaaagatggtgaaggatgtttatctgttaatgatgaagttcaaggatatgtaccacgctacgctaaggtgaccgttaaaggatatgatgttttgactgatcaagaagtgaaaattgttgctcgaggattcttatcaatttgtttacaacatgaactagatcacttcgagggaactttgttctatgaccgtatcaacaaagaaaatcctttagcacctattcctaatgctatggttattgattaaaaaaacgactatttgtagtgtcttcaaaaagttactctaactttaagaagtgctgcagatcaagtcgtttttttcttataaaaatttattaccaagcctaataacaacattaatacgattgtaaccattaaattattaatcgtataagggtgataatgtaacctaattcctctaacatctaccaagaaatcatatacaatttttaatacaacatctttaaaaataaatactaccatcaaacaattataggccttaaaaactcgatttaaaattaaattatactcttctttactatctttctttattaataaatgttctagattattgataaacaaaaaagtactaaaaattaaaaccactgttaataaaatatcactgcttaataatgcataatcgtaaatattgtattttagatgatgcagataagcctgataaaagctcattaataaatgggcaactttatctactaataaataaagatcaaaacaaattatcaagtgtcctaaaaaaacaatattattaaacttgttttgacatttgggttggtaccacaaataaagtaatgatagcaaacaaatcaaggcaataatacctattattatttcgagataactaactagatcataacttttattttgccataacatcttcagcacctcgattccaataacttattcctagtatattgataaagattgtaacaacaataattgcaacctccggtaatcccaagtatggcaaagcataaagaaatatatcattagagctgctagtttgattatttaatccaaataattccaatactctagctagtttaacaatcagcggaacgattacagttctaataataattaagatagctataatatcggcattaatagctaatttacgaattgcatcacgactactatttttaataaaatctaaaatatttttcaccaaaaaaatcattaaaatcataataattaaactaatcagatcataacctatcttaatcatccactcaaaattgctctcaatattaaaactagcattattaaaccaataaaccatcagctcattacgaatggttcctaacattaaacccgcggtactaataataaataagaacgcaaagaaacggcgccattttataagacgacgtcgcattgaaaatagtccatttaaacagactacatagataaaaagcagcaggatcataactatattattaatatgcatggctaaaaaactctgcatttaatcacctcattaaaattatacatgaggactaataaaaaaactagaaaaaaggctattgttttgaacaataaacaatagtcctaattattttatattttagcaaatgcttgttttaaatccgcaattaaatcttcaacatcttcaagaccaacagacattctaattgtttcttgttttaccccacctgctattctctcttcctctgacatttgagcatgtgtcgtacttgcaggatgagtcagcaatgaacgtgaatcagcaaaattagtaacatgaataaataatttaatattattaattactgttttaccaccagcaacaccacctttgactccaaaagtatataatccaccaaaaccattggggaaatattttttagctagttcatagttaggactatctggtaattccgcgtaactaacccattcaacatcatcacactcatttaaaaattttgctaataatcgggcattttcaacgtgttttttcattcttaatgataatgtttctaatcctaataaagtcatatacgcattaaacggtgacatacaccctcctaaatcacgtaatgtctttgctactgctttagtacaaaaagcacccgctcctaaatcagcataaactatatcatgataagctttgtcaggcatgttaaataatggatagcgaggattatctttccatttaaagttcccactatcaacgatcacaccacccataacattaccatgaccagctagatatttagtagttgaatagactactaagtcagctccatattcaattggtttaaataaataaggggttggtgttgtgttatcaacaacaaataaaatttgatattctttagcaatagcactaattgcttcaaagtctaacatatctccattaggatttcctaccgattcaacaaaaataatttttgttttatcgttgattgccgcttttaaagcctctaaatcagttggattaataaagtgtgtcttaaatcccattcctgccatcgttcctgataaagaaccaatcgtaccaccatacaaattatttgcagcaacaatttcatctccagtttcacacacagtcataatcaatcccataattgctgcagttccagaagcaaatgctacagccccgaatccgccatctaaagccgccattctttgttgtagagcatcaactgttggattagataatcgagaatagaagtatcctccttcctctaacgcaaaaattcgcgccgcttgatcagcatcttcaaatgtaaaagcatttgataaatataaaggcatccccgtagccttagttgtcacatctggcttttgaccagcatggatttgtaatgtttcaaaaccatagtttttattatccatagtatctcctcctaaaattgataaaattgtatcacaccttgagctttttttccatataaaaaggttggtctcccaaccttacgataaattattttttaagaaaatcaggatatgcctcagaaccatgttctcctaaatcaagaccagcaagttcttcctgaggtgttactcgcaacccaaccgttttcttaattaaagtaaacatgatgaaggacattgaacatacccaaactgctacaataattacaccaatcaattgcgtaatcagtaaagcagttccacccccaaagaataagcctaaagttccttcacttgctggggtattgcatgcaaataatccaactgcaagtgttccccagacaccatttaaacaatgtaccccaactgccccaacaggatcatcaacatgtaatttttgatctaagatttcacagccataaactactaaaatcccaccaacagctccaattgcaattgcaccatataatgaaacaatatgacaaccagccgtaatcgctactaaaccagctaaaataccatttaaagtcattgaaacatctggttttccatattttttccaagtaagaaacattgctactaatgcaccagcacatgctgataagtttgttgtcatcgcaatatgacctatataacctgctgcttctaaagaagaacctggattaaatccaaaccagcaaaaccataaaataaatacgcctaaagtggccatcatgatattatgaccaggaattgcattagtactgccatccctattatattttcccattcgtggacctaaaacaactgcccccattaatgcggcccaaccaccaactgagtgaacagcagtagaaccagcataatcaataaatcctatttttgataaaaaacctccaccccagatccaatgaccagagattgggtaaattactaaactaattactaacgtataaattaaatatgatgaaaatttagttctttctgccatcgcaccagaaacaattgttgctgccgtagcacaaaagactgtttgaaaaaagataaatactgttggtgaaagtgcctcaaactgtgataaatttaatgacgtcggatcaatgaatcctgttatacctacaattccccctaatgattcgccgaacatcaaaccaaaacctactactaaaaatataattgatccaattgcaaagtccataatatttttcattaaaacattgttgcagtttttttgccgagttaagccagcttccaaaatagcaaaaccagcttgcatcagcataaccattaccgcaccaagaaacacccaaacaatattaattaattgttccatatttgatcccccttttaatttttataaatctgttacagagcattttctcctgtttcaccagttcgaattcgtactgcctgttctactggataaacaaatactttaccatcacccacattaccagatgaaagtttggttgtaatttctttaatcatttgatcaactacttcatctttaacaactgtttcaatccgtaacttagaaactaagtttaccgaatatttagttccccgatattgttgagtatagcccatttgattaccaaaacccataatatttgaaaccatcattccggtaatcccacaatcagttagaatatcttttaaaatttctagcttctcaggtctgataatgatttctagttttttcatacttaaaattccccctttattttttgatttaaagtttatcgcctttaaatcttaataaaatactatcagagtaataaattattgtcaattaatatttttataaatatatatattttattaaatttaggattttaacaaattataatttaattaaaatattaataaatttccttaaattctttataataaaaagaaaaagctatcctaagatagcttttaataatttgttattagtataaatttactaatttaataataatcccttaccaagttcaccatatcttctacatataaacgagcagcatctattacacattgatcaatttcctttaactgcctaaatgtaagcttaaatgaatattgctcacgcataagtggtaaatctgtttcttgacataatttaatcatatttttcattttatgatcattaatgtagaaagcattaaacaaagcaatattatgtactttttgtctatttaaacttttaataaatgtctctaactgcggatctttccaagccgaatcatcaaagccaataactaataaatcgactggagcaagagcatcaaattgatcaatcgtctttgcatatgttttaacccatcttgccatagcttcagcaacaggcttgatgtgttttgatttacttgtatatagaatttctactctcatttatatcaccttctatattttaaagtgtttttgtgaactatatgttaaccatgattaaattatatcatttaacaattttaaatccactttttaattttagaaaatgaagattgtggcacactaacattaggaggtagatgatggtaaaaaaattatttttggtaggtatcatgttgttatcattaacaggctgcgtaaaaggaaatgttgacatcgaatttattgatgaaagtaatgcatctttaacaattgaagtactcattcaagaagatttattagattcttatggtacctcacttactgatttaaaacataaattaactaatagtgagttgagtacgtgggaaaataaagaactaaaaaaagatattaatggtacccaatatataggatttcagcttattgcaccaaaagatattaataaaagcttattgagtttcttcactacaaataaaaaagaaggaacttatcaagttacgatcgatcacagtactattaacaatatttttaatacaagtgaaattgaagatattaataattattctctaacaaatttgaagactatgggactcgagctaaatttaaatattaaaatgccgggaaatattagtgaaactagttatggaaagatccaggataatcaagtcaagattaatctattagattttttaactcaggatgaaacgaagtcaatttcaatcatttctagtaatcggcatcaaacgactcagcctgcaaatatttttatctttgttgcactaattataattctttacattattttaagaaaaagacgttaatcacttaatatgtcttttttttactgtctaaaaatgatagaattaggcaggaaaaaggagaataagatgaaaaaaagaaattgtattattggacaatctggaggacccacaatcgcaattaatgcaagtcttgctggaatcattcataaagctaaacatagcgaagaatatgaaaatgtttatggaatgatcaacgggattaaaggtttattagaaggtcgttatatggacctgcttgaggaatttgatacaggtgaaaaaattaatgctttaaaacaaacaccagctatgtatcttggttcatgccgttttaaattaccaacacatattgacaaccaagaaacatatgtaaaattatttaaaattttaactgaattagaaattactgatttttattatattggtggtaatgattcaatggatactgtcatgaaactagatgattacgcaaaatcaatcaatagtgaaattcaatttatcggtattcctaaaacaattgacaatgatttaatgggtactgatcataccccaggctttggttcagctgccaaatatgtagcttcttcaatcttagaagtagttcatgatagtttaatctatcagctgcaatcagtaacaattattgaaattatgggaagaaatgccggatggctcacagcagctgctgcactggctcgtaatgaatataatgaagcccctgatttaatttatctacctgaagtagtttttgataaagaaaaattcttagaagatattcgagaagtatttaaacgtaaacgctgtgttgtaattgctgtaagcgaaggtatcaaagataaagatggtcacttcctcgatgatgattctaaatatgctaaaaaagacgcttttggtcatgtacttcattcaggaactggaaaaatgctagaatcattagttttcaaagaatttcaatgtaaagttagaagtattgaattaaatgtcttacaacgatgtgctatgcatattgggagtaaaacagatttaaatgagtcatttgtagttggacaaaaagcaatagaaactgcgttaactggaaaatctggccaagtaatgggatttaaacgaatttcaaataccccttatgaaattgattatatttcaactgatgtaagaaaagtagctaacttagaacaaaaaattccaactgcctggattaatgaagctggaaatgatattacccaagaattatatgattacttatatccgttaattcaaggtgaagtacatattaattatttaaacggtattcctgcttattacagctgtaaacatcttaataaataaacagtgcaatgcactgtttttaatttatccaaatttcttttaatctatcaactgcttcatcaatatcttgatctaagattcctgaaaaagataaagtaatctgattattactatttttattaactaaaatatcattttgttttgctaaagcaatatattgatcaaccaaatcagccttaattgccattgtgatttttaatgaggtttcatataattcgaatttatgttgaggaaaagtagttcgaagcttttgtaacaaatgagtacttttattgcggtaatgttttcttaatcgctttaaatgtcgtgctaactgtccatcttcaacatacatagctaaagccagctgttctaattttgatgcagtctgatgataatctcgagacttttcataaaataactgaactaattggtttggtaatgccatataactaattcttattgaaggtagtaataattttgaaaatgaaccaatgtaaataatgtggtcattgtctagttttgacattgcatcgattggtttagtgttaaatttcaattctccattatgatcatcttcaataatatagacttgattagctctcgcatattcaatgatttctaaacgacgctgttgtttgataggatgaccatgataccctccagaagaactatttaaatataataattttaaattagcttgtcttaatccctctaaagtaatgccttcttcatcaaccggtaacttaactacctgcatatgacaatcatgaaaaacggcctctgcctgtttgaatcctccttcctcaattccgactatattatctttaccaaaaagactacaaacatgataaagaagaatttgaaatcccgcaccaataatataattatttacaggatgccgaactccacggtattcatggctatattcctgcaaagctactcttaaaggcatttcccctaatggttctccataactcattaaatcttcactttgatttaatgcttttttaatatactttttccaagtatctaaattaaagctttccacatcaacaagacgtccactaaaatcatatcgataatggtgactatcaatttttgtaattacttttggattctttttatttttaatttgattactaaattgcacatccacataatatcctactttttcttttgcgtaaatataaccctcgactaataattgtaaatatgcactttcaaccgtagttctgcttacatctaattgttttgccattttacgaattgatggtattttatcattatattttaaataaccattttcaatatcatcaacaatagtttgataaacttctaaatatttataatccttcataaacagtcccctttaaaagtattataaattactattttaataaagacaactaaataaaattataatttttatatcacttacacttcaatatgtgatataaaaagaaaaaggatgtgaatttattatgactattaaaaaaagtgttttggatacaattggaaaaactccattaattcaaattgaccgctttaaaaaagcatgtgaagtaaacaacaaaatatttgccaaagtagaattctttaatcctggtggcagtgttaaagatcgtgttggtcttaaattaattgaacaggcttatgaggatcaactaatcaataaaaaaactacgattattgaacctactagtggtaatactggcattggtctagcaattgcgtgtgctatctatgataatgaattaattttgacgatgcctgaaactatgtcattagaacgtcaaaaattattaaaagcttatggagctaaaatcgtattaacggctggagaaaaaggaatgcaaggatcagtcgataaagctaacgaacttgctaataagattgaaaatagctatattccaggtcaatttgttaatccaagtaatcccttagcccatgaagaaacaacggcattagaaattattgatgattttgatgataatattgactattttgttgccggaattggtactggagggacaattacaggaattgctcggatattaaaaaagaaatatcctgatattaaaattattggaatcgaaccaaaagattctccattaatcactaaaggaaaagctggatcgcatgatttgcaaggaattggagcgaattttattcctaaaattctcgatttggatctagtcgacgaagtgataacagtttctacggatgatgcttatgaggctgcacgaatattagcaaaaaaagaaggcctactagttggaataactgctggagctgccctgcatggagcaactaaaataacagataaaaataaaaacatcgttgttctactgccagatactggagaacgttacttatcaacatcattatttgaataaaaggcatagcaattgagtagcattaaaagtattttacacaatgctcttcagactatgttttttattttcctaaatgtccagtgagaatgtagaatgatatcttattattataataaccaatacattatcctctataactttaattttgatttattctttttaactgtactaattactttttcaaatcaacaggattttaactgaacttttttgtttaagctcgtccatacaagacaacttatcatatcacctcaatgatataatttctgtttattaagatatcaattacaaatattccaagtacttttttgtatactataacaaaaaaaaacattgtccataatttaaagatattttggacaatctttttggctaatattgatattgactacaatcacctcattacaactaatcatctttctctgctcttcttcccgtctatttatatttttaaatagtgaatctcattattaaactttaaattattagttgtttatcctagttgcataacaaacactcacatttttatgatagacttttaaaatataattataattaaaaattatttttgtagttagaaaaagatactgtccctaaagacagtatccatattattaatcttgttcaactaatgcagttgataaatagcgttcaccagtatctggtaacaacacaacaatgtttttgccagcattttcaattcttttcgctaatactgttgctccataaagtgctgcaccagaagaaatacctactaacactccttcttctctagcaattgcacggctagtagcaaaggctgcttcattttcaattgtaataatttcatcataaatatcagtatttaaggtattaggaacaaaacctgcaccaatcccttgaattgcatgtggtcctggagttcctttagataaaactggtgaggcagcaggttcaattgctacaaccttaatattaggatttttttcttttaaatattttccgattccactaattgttcctccagttccaacaccagcgacaaagatatctatcttaccttctagctgctggtagatttcaggacctgttgttagataatgtgcatttggatttgcttgattttcaaattgactaggaataaacgcatttttgtattctttggccaattcttctgctttggcaattgctcccttcatgcctagtcctcctggggttaaaactactttagctccataggcttttaataaatttcgccgttcaatcgacattgtctctggcatagttaaaattacttggtgtcctaaggatgttcctaaagaagctaatccaattccagtattaccgctcgttggttcaatgattacagaatccggttttaaaattccatcttctttagctttaaataacatggctttagcaattcgatccttaacacttcctgcgggattaaaatattctagtttagcaaaaatatttgcttttaattgattttttgtaacataattgtttaattttaaaattggggtatttcctactaattcactaatatgattattataagtcattactatttcctccattttctttatctaatcaaatctattattaacaacagcctctatttttataaaaaattagctcattcattatagttccctcttttcctatcggattaatatgattataccttgagagcaaatttatgtcaatagttatataataaaaaagccttacggcttttatattgaataattattcacttgcatatttgcatgatcgattaaatcttgaatagttacactttcaacatagtctttaatcactttatctaatccttgccaaaacggtaatgtaatacattcattggcacgactgcaattattaatttcatctttcaagcagggaattggagctaaatcaccttctgtaattcttagaatatcaccaattatacattcttcaggtttttttgataagcgataacctccagcattaccacgaagactttgtaaatagcccgctttatttagtaatgaaattatttgttctaaatacttaaccgtcagatcttgtcttttagcaatatctttcagtggaatatatttaccatcatcgtgcatcgcaatatcaaggataactctaattgcataacgccctttggttgaaattttcatgatgttcacctcgtttatataatactagtattaaagtaggaatacaagtaaaataaagcaaaaactagtcatttatcgcatcatttatccaattatcttctttttcaagcaaatatacatggtcaatatcttctaatgtttctaaaaaatcacttaaatctgttggggtaattacaacatgttcgacaatactgctcgttttagtcacttctatattattagctagtagtgcataataaactaattcactacaatataaagctttatcatcataagttgtcatgctgtaatcatacggtgttcccaaataatctaacgcccgacttaaatatgtcttaataaaattatcatcctcattaaaacgatagccggaaagtgcttttaaatacgattcttctttaagattagccatttgatcaaatgtccgtattttaacacccgtagaattactgtcgagtactaaaacctcatcttgattcttataatgtttattaatttcctcataatatttatcttcaggtgtaaaaacctgactaaactgctgatatgttcctagatagaaaatagtatgtttccatcttcctggaatagcatatgaacttaaataattagtattttcaatattaataatatctcctgttttaaaaatatcaagatattctaatagttctttataagtaataacttcttcttttttaactacaggctcttcttgaaccacaacagcttgatctcttttatcaggttttaaattaaagccaatactggcaattattataataactattccaactagaaactttttcatcaactcatcctttatttaatcatacttaatccaacacgatgtttgttgacatctacatcaatgacatagacttcaacaatatcacctatacttagtttatccaaaggatgcttaattctttcatgagaaatcttcgaaatatggactaatccatcattttttaacccaatatcgacaaaagctccaaaatcaacaacattcctaactgttccttctagttgcataccgggttttaaatcttcaatttttaaaatatctttctttaataatggtgttgcatatgcatcacggggtgagcgatttggctttataaaactatcaataatatcatctaacgtataattgtcgatatttagttcattcattacttcctctttgttaatatttgataatttatcagcaatttcatttgttcctaataaactagcatcagcatctattaatttaagtaatttttttgcttgttgatagttttccggatgaattgctgttgcatcaaatggatcattagctccaggaattcgcaaaaatccgattgcctgctgatatgtttttgcacctaatttactaacattcataatttctttacgatttgtaaatttaccattttcatcacgatatttaataatatttttggccactccgctatttaacccagcaacatattgtaataatgatactgaagcagtattgatatcaactccaacattatttaccgctttttcaacaacaaaatctaattgttcttctaattgtttttgagcaatatcatgttgatattgtccgacactaattgcttttggctcaatctttactaattctgctaatggatcttgaagacgtcgtgcaattgaaaccgctgatctttcttctacctgataatctggaaactcctctttagctaatttacttgctgaatatactgatgctccagcttcagaaataattacataatcaacatctaaattattatctttgattaattgagaaataaaagcttcactttcacgacttgcagtaccgttaccaatcgcaataatttcaattttatattttttgatcaaatttaataaaattcttttttctttatcataattatcttttggaatagtaataaatactttatcaatcttcaatacttttccggtctgatcaacaacagctaatttacatcctgtccgataagcaggatccagacccaaaaccattttatcttttaaaggtgcctgcattaataacttttctaaattgattgaaaatacttttaaggcctgctcgctggctttttcagttaattcattacgcacttcgcgttcaatcgatggcaataataaacgatttaaactgtcttctacagctttcaataaatattcattaacactgctattacgatttctagtcactccacgattaatatattgaattaaaaattctttatctaaaacaatattaacagtaataactttttcattttcggcacgattaatcgctaaaatacggtgtgatacaattcgattaactcgttcgtgataatcatagtacatttcatatactttattttcatcaggattcttcttttttacttttgtttcaatcgtaccagatttatatattatatctttaacaaatttacgatatttaatatcatcactaattacttctgcaataatatctaaagctccctgaattgcttcttctacagtctcaactttatcatttaaatatttttttgcttcttctttaagttctccccttggcagtgataaaatccacttacttaatggttctaaacctttagctttagcctcagtagcctttgtttttcttttttctttataaggacgataaaggtcttctacttcatttaactttgttgcttttaaaatatcagcccttagttgatctgttaacatccctttttcttcaattaaacgaattacatcttcttttcgttttaataaactaacttgatattgataatatttatcaatatttctgatttgatcttcatctaaccctcctgttgcttctttacgataacgagcaataaagggcacagtatttccctgttctaataatgataaaacagcattgatttgttttttagttatttctaattcttttgatgctattgcaataatttcttcgttcataataactccttaattctatttgttttcaactaccttattttacttcaaataaataaaatatcaactgataaaagaaaaagtcttgaatttcaagaccgttattttggatgactataatcaaatttaaaatattatcactggatatcatgaacgttctgataatattcttcaattgtaaaaattatatcattataaatttctggatttaacagttcttttgcctcttgtatactcacaaagcgataatcactatgctcatgcgataaacggacatgatcattcttgggaatacacaaatatccgattcctacggtttgataatcttttctaattttagtgaaagtataagctggtttgattatgataatatctaatccggtttcctcttgtaattctctgattaatgcttgattaggtgtttcaccatattccaacccaccacctggtaactcccaataacccagaccatcacttgatggtcgaattcgtttcattaaaagaatctggttatttaatacgacaattcctttgactgttatgtgaaatcttacattattcatgtcatacctccgattattatatatatcataacactattattactaaaattgtttaaatattataactaatagtgttataattgatgacgaggtgataatatgattgattttaaagcggaagttttaaaaataaaagatcaaatgattgatgatataaaaatgttatgtgccatcccttcaactcaagatgatagtaccgttgctgagtttgctccctatggcgcagccaatcgccgagctttagatgcaatgttagaaattggtcgacgtgatggctttgaagtgcaggatgttgatggacatgctggacatattgatattggaactggtgatgaaacttttggaattttgggccatcttgatgtagttcctgtaaacaaggttggatgggatagtgatccatttgaagttattactaaagaaggaaagctttacggacgtggagtcgcagatgataaaggaccattaatggctggttattatgctgcaaagatcattaattctttaaatattcctacaaaaatgaaaactagggttatctttggatgcaatgaagaattaggtagtaattgtgtaaaatattatttcacaaagatgccttatcctaaaatgggatttactcctgatgctgcttttcctgttgtttatggtgaaaaagcaggttgtggttttgaaatcacaggacatgttgaaaaaggtggattaatctatttatgtgcaggaagtcgtccaaatattgttccagaaacttgcgaagcagtaattgaagggaattacaaacaatatactgaatcttataagaaattcctaaatactaataatttaactggggatattgaagaggaaggaaatcatactaaattaattcttaaagggaaatcagcacacgcaagtactcctgaagagggcattaatgctgttgtatatttatgcaaatatttagcaactgtcgttgataacaaagttgttgattttgttcttgaatatttagatgactgtcatggtaaaaaattaggaattgaccataccggtttaatgggtcctcttactcttaatttaggagttatatcttattataaagaagaagttaaaatcgttctcgacttacgttgccctcatgacatggattttgatgcaatggttacaaaatttaaacatgcttgtgcaaactatgaattcagagaaactcatgatttgggcaaggctctatatatcgatcctaattctaagttaattactaatttgcatgaagcttatgttagtgtaactggagatacagttaacaaacctcaagcaattggtggcgggacttatgctaagtcaatgccaaactgtgttgcttttggagctgaatttttgggtgaagataatttaattcatggtaataatgaaaatatcaaaatcgattcgttattgaaagcaacagaaatttattgtcatgctttatacaacttgattaaggcagattaaagaaaaaagtctagaactttacgttctaggctttatttttctgcaataatttgataaactattaatacttgcagacatggcgaaactggtatacgcgctatcttgagggggtagtgagcaatagctcgtgcgagttcaaatctcgctgtctgcaccaatgccggtgtagttcaatggcagaacgcatgaatggtaatcatgaaatttaagttcgattcttagctccggcaccatttttttcacttcgaacaacagttagttaagacggttattaacaaagatgtttttatataaccatttaatctagctaaagcgaagtttaaaaacgatgctattatagttgaattgattttttaatacgatatactaaatacaagttattatttaacttatattttttaaaacatatatatattgttcatcgattctaacttctctttagaattagatggtctcttagagtgatctacggtcaatagacactcttttttgtttgtattgtatcaagttattatcaattttagcacaataatatgattaataaaaacattataacaaaataacaaaaaattcatatgttgcatgataatcagaagttgagggtgttttttgaaatgttcaaagacattaaattcagtcaaattccgatagactttcgctgatttttctattaaaatcatctacttttttctttagtctcagcagtgcctttttatccttttcaaagttagataggctgatttttgatttcttcagctgctcttcgcatttagaaactgtaactttctcttcatcaattttctttttaatttgtaatcaaatcataaattatgttttttataaacagttatgtatcatttaacacactatctttacggttatatttttgaattatcccattgtgtgcaattccaatagaacaacgtaaatttgtttttctaaggtatatactgtcatcagtcagcgggtatggatgacaatttccctcatcaattttaccacttgttgatattctaaaatgaaatacaacactttgatttttcaatttatagagcttatcatttatttgcaaattttcataaaaatcatcaaaaacataaaaccttttttaataataactacatcattataattgtacatgaaccctgcaccatgaggatttttattccaacatctttttaaaatctctttatccggtaagtccattctgctattttttacaataattatacacatattcattgcctctttcttctttaattaaggaatgcattccttattttcttcgggtgagtaagcaatgttcccagacatctagaacctatttcatgtaaaaaatcaaaacaataaaatgaattaattgttttaattaacgtctatctatatttatttgccaaacataaaacttgatggtcttaaactattattaggcattaatgatagtttttttcacttcctttatatcaacttttctattttctatatcattattctcaatataatttttcatcatttgtattgttttatcattatttttatatacaattaatttttccaaattaatcaagccttgatagtttctagatacatttacaatattatacattaaattgatacgtgtattaaaagattcccataacagcgttcctcgacataatctaatctcaacagttttttcatttgtagtattaacaaccttgtatctattgtgacgatttctatcgcttttaattttatcttttgcaactttttttataacttctatatcatatccatttgatgtttcaaactgacaccagcgtaaactgcttttatttcgtccactgattttgattaattcttctcgatataattccataacagcaaccacattttcaatggttttatttgctcttttgtggtctacttcttctgcttttcttatattattattaagattacttaatagagaactgtattctttagaattaaaacctagtgtttttctattgaaataaatgtgtgaaccacatttatttccttttgtagaaacatagtgaaactcattaaaaatatttaacaggtttttaaacttattgatattttttcataatatccttttgtcattggactggaaataatctcaagaccgtagccaatcgacccatctctttcatatacaaacaagtctccaaattcattttcaagcttttcagcagtattcaaaagacgtctccactgtggctcatctatatcgtagtttttataatcataccatttaccaatagttggtttaaatccgcccatactgcccatcccaccacaacttcaaatttgtttgctaaaattatagcactcaatacgaatttctctatcatttctttatatttgtccatatcgttttatttcactatggaaaattcgggcaccaaagcgtcaaatccacttactattttgaatgttctaatcaataaaaaagtctatagttccaagaatttgcaccatctaatactctccaatacccaaatttcaaataccatttttcttttccattcctgtaattgggatactttactgatctatcaaataaagctaaatattttgaattacatttttattcaacaaaaaaagcaactgtaaaaaattgcttaatttattttaatcaattattaaattaccattattaggcttagcagcactagaattattattagatgaactatttgatgatgtactaccacttggtttaatagttgaaatactgttagatgaactactagaagatgaataagaactattattacttgattttgatgtatcacccgaagtaactatgcgaaaatcaccactctgtgcttcggttttctttctagttacaatctttgtagttgttgtaccatcagcgtttgatactgtttcctcaacaattacttcatcagcactcaatggagcaacaacatttatagctacttctttatcacatttatttccataattgtcttctgaaataatttttaaagtataagcaccaattgtatttacatcaattgcactagtatcatacttaacatctgtttgagataaatcatcaattgtataaagaactttaaaatcataagtacttaaatcagtactttgtactatatcaatactttctgcacctgtaattactggggcggtagtatcttcaactttataagtaaaagtttctttttcgtttttatatgaaacggtaactttatattttccaacatctaaacaaaaattttcaatattattcaaatctttatcaacagttacctttgcgttttccaatacatctttttttacatcggtatctaatttttctgtatttaaatacgtttcaggttttatattgaatggtgtaccaagttcaactttaaaagtattttttttcaatacaagataatctggctctttatttaaaacgataaagcctacaatgataaatgctataacataccagtattttttacaattctttaaaatcttttctttcattgttttaaccttcctcacatttttagtatagcatagaatactattgtatacatattgatattggaaattctaatagtattaacggtttccgtcttaccgttaaaacacgatcactaaacctagaaatctattcactcccaataactctaaatttaatgagaaaaatatctaatacgctactcactttttttgttggtttggaataagtcaaccgttatgcttatattgctttatttatttgactgatatttttttcagcattttcttgatattttcattcgtcaacacaacattagcgttttcagttatactgtattcctcgttttctatgatgataccatgaaatattttctcgtaatttcaagaaagcatacggaatgacaccaacagagtataaaaatatttctattattttataacattttaacataccagatatttctttaaaatatcatattattgacgaagatatgtcaattttagcgaatagtattgtattggaaataacacattccacaatagatattcctaaatattttgttggatatgtggcaagtagggaattaaaagcaccactcaatattaccacacatattttaatagttctttacgttttaactttcatatacaaggaaactgtactgaacgtttttctctaaagacgtaggtagatgcttttttgaaatataatgctttaaatgaataatagcactcatgccttatgtcctccgatagtattatttctgtctttgccagttgctccaactactaaattcataccttttaatacagcatttttcccatatttctgcttcagtttcaaagttgcctcctgaagtcttttttccttttctaaatctttttcaagctttacttcttctttttttaactgctcgtgatcagtaaacagatccatttgctgtattgtcgattttgttttaatactgctttcatcagtaatatgattagcagacaatgcaaaacgtcttattgttaattttttattaacactgctgtgtcataccagtttaaaactttttgtgtaaccagctttgccgatgaaatatatctgcctatattgacagttccatgagcatgttttggaatctttcgtccatatctgtcatcctttatttcgccagtatagtcagttttgatgttttctttatcatagccaacacttactgtaatctgatctgttactagttttttgccacaagatcgagacacaacgagtcaatcatttctttaaggactattcttccttcatcaaaagtatacggtctgcttaaaacctgtccgcttcccagactgctgctttcaggtttatatgccttgatgtgtttcattgtacaaggttcgtatccccatgcatgatcaatcagcagttcagcattgactccgaacatatcataaagaagatcttcattgtaatatttgtcttcactgcctacagaacatttggcaatatcacccatggtatacaatcctgcttcattaagcttttttgcatatcctttgccaactctccagaaatctgtaatcggctgatgatgccataagtatttccgatatctcatttcatctaaacaggcaatccgcactccgtcttcgtctgctttaacactaaaagacagagtgatactaatgtagcacttaacaatcttaattcattaacagctacagttaccaataagctaaataatggcgattttatccccaaaatcacggctgaagctgaagttggaatagtaccagaagttcgggtattaggagcaaaagatattcaacacgatgctctagaaaaaatggaagactatgataaggattctgaattgattgttgaaggtagagattatagcacaattaatgacggtcactgcaaccaccaatttaaaaatgagttccttatcaaacaaagcaaaataacaaaagttaattttagagaataacagtctctccccttttgtgctttgcaacatagagaggaaataataaatgttattagattttattaaatcaaactggaaagaaattactacatggttggctttatttggtgttgtggtagaagtttctccaattaaaatttattcacttcgttgggttggaaacagaatgaatgctgacataaaaaaggaactagataatgttaatgaaaatttaaacaaacatataactgattcagaaaagaaagaaatgaaaaacttgaggtttcaaatgttggattttgctgatcgtgtacaaaatgatagtaaaccatcgaaagatgcatttagtcatatattcgatactattcaagattatcatgatattattgataaatatgaattaaaaaatggcttgattgatatagagactgaaaatataaagcaagcatataaaaaattatatacataaaggggttaggacaaattaatgtcttaaccccatttttttgctttattaaagccgagcatatgattgattataccaattatagcttctctttaccccacgtaaaatatgatatgctcggcgataagacagtgttataaacttacaataacagtaccgattagcacagcagtataattagctttttcattcccaacactacaatatccttcaaatcaataggtggaatcttatatcatcgaggcatattatcatatgaagtcacataatagaaattatctatttttttgactttaaatgttcctcccatattattaggctttccaataatactttgcgttatcatgtaataattgcattcatcattcttttcaatttcttcactatgaacttcttctattttcataaaaaataccttatatgttgaatttatattataaacatattctgctattgctttttgtggtgttgaattatcaaatagattgcttatataattagtgtacaatttcagcccgacaaaaaatataattataacaatcaaaatattaaatactttacttctcaacaatttctttattttttctttcattagaatctaatccttacgtatgttccagaggtattttcccatccatttactgaagaacttactttagcacaatagttacttgtatgttgtgctattgttacatcataatatccactagatgttttactcccagatgcaactacaaaagcaacatgattatatcgtccatccttctcccaatctgctattataaaatcacccgcctgcaaattacctgagaatgtattaaagtttcctgatgcatattgactattacttctagaataccagtatgtttcaaaattatgcgcagctgaccaagaggctgtatatggtttccatgtagtatttgttggtgcaccacctgaccttagaatctgcgatgcaaaattagtacaatcggtactatatgttgtatagcttggattaggattaacagcatatttttttgcgtaacttactgctgtgcttttattaaagttaaatgaagcagctcgtgtcataggcaactgattaatagtatcaattataggacttgtgtacggtaagtaattgattaattcaaaaatatcgacattttcctgattacataaaatcctagcttgactatttatttcatgattttcacatactgtgaaaaattgatttaagatatttatatcttctatatctccactagcaatattatcaaaatacatttctttaaatacattaaaatattctttccaattgtttaagcttaatgtgtctaaatttccaactgatgagatttcatttaattcatcatcaaatttgctaataataatatcaaatgcagtactcatattatcaaattcccaaaacaacggattgctagttccattaacatttaatactcctcctgattttaaatcaacaatattttctaataaattgtaaggagattcactataaatattacaatctgcatctaggcttatttctttttccattgcagttacagtagaaatattagttggaaatattcccactaaaaatacagcaataattaaagatacaataaattttctactcttttttataacatatcttcctttcatatttgttgaaaacgtttccttaactatatgatagcactttatttacatatgtcaatagctacatatattttatatgtattgaattatcgattatattgtgatttaattatattaaagataggagatggattaatgagcagatcttcaaacaatttttttaggatggaaatgttgctgttaaaaatcatagaaatcggaaatggcgaatattatggttataaaatagtccagcagcttcaggagttatctgatgataaaataaagttagctgaaggagtcatgtaccccatcctctatcggcttttagacaaaggttatattatcgatgaaaaaaggcttgttggtaaaagaaaaacaagagtttattataagcttgaaccaaaaggaaaagaatatcttaaccaactttacattgattacatggatataaacactagtattattaaaatcatggaggcaggaaatgaataatgttgtcaaacaatatctaaaggaatgtagacgtacatttccatttataagtaaaaatgaaaaattattttttaagcgcttagaagataatttgaatgatattgacgaaaacgttacttataaagaaatatgcttaaaatatggtgaaccaaaaaatgttatgatttcttatatagaaaattgtgacaatgaatatatcttaaagcgaacttctattaagtccattgtgaagaaaatattcattaccctattttgtattctaatagcactatgtgctacacttcttatttataatcaattgatatacaatgcatatgatgattctaatactataaaaaaagtaactattattgaggaggagtaaagaaaatgaaaaaatatttgcaagttttttaactgttttaacactattaggcactacacctgtatttgcattaaatgaagaaagcaatacacagatagtcgaaagatttgaggacggtagttatatcgaagtgacaatcgaagaaatatcaacgcttacaagaagtaacactaaaaagggtaataaaacaacatactacaaaaacacatataatgtaatcttatggtctgtcaaaatcagtggaacatttacttatgatggctcaaccgcaaaatgtactgctgcatcagttgacactcaatgtccagctataaattggaaattgagtaatattagatcatcaaaatctggtgcaagcgcttatggatacgcaaccgcaaaaagttataacggtcttggaatggttttacaaactataaacgaaacagtaaaacttacttgcagtccaagtggaacattatcttaaaacaattaaaaataggtataacatcgaaaattaatctttttgaatgttatacctatttttttgcactattcagttaattcagtttcaattatcccgtgccagcaggtgtgatttttcggagcggttctttcgggtttgacaactcaagcatctgataatcatatttgcttgtatcggcagcaccatctatgtaatcagcttcaactctgtatactgggtacgagtaatctttcattccctttaaatcatctaatatatcttgctgaatatcttcaaacacatcatctatgtcctcagccatttcgactcctattaactcatgtgatttagtatttttccaaatacacttaccgcatctaaatactagatatttattcatttttctttttctcccattcagcttgtatttctttttcagccgcatctaaggttagttcccctatgtcgtatatagtcatattcataatcatattgataatcattgcttggcaacaatatccattgctacttttgcaagatatagatttgttcctattcccgttgtggctgttattcctgttgtcttataaatatcctgaataatcatttttgcaaattcccttggagatgtattaacagtcttaagatagctcgttgcatcaataaaaacctcatcaattgaataaacatgaatatcttcagctgaggtgtattttaaatatacttcgtagatttttttactgtaatcaatataaaatgccatcctcggaggggcaataatgaatcccagttcaagacttgtgtcattttttaactctgacaatatgtgattttcctctaaactccctatatctgttatctttttttctttttctattgatttctttgactttttgaactacttcaaagagccttgctctaccgccgataccatactgtttaagagaaggagaaacagccaaacagatcgttttttctgttttagttgaatcagcaaccaccagattggtattcagtggatctaattctctttctacacattctacagaagcataaaaagattttaaatctatagccatatatatcctgtttcctgcactcatcattctcacctcaactgcctttaatttaattattaacacatcattaataattaaactgattctaaaacgattataaaatttaaaagtgcgtaattcaactgaactacacactcaaacattaattatttacttttaactgacaaattaagttttcatatttaattaatataattgtaatgttcagtaaaatctactaatatccccatattcatatccttaaagcagtaaacagccatattagacttttaatactttaataaatcaacattattaataatgagaaaatatatatatttaaattacaaaattatagggtatacctcttcttttttataaaaaaacttgtgtgttcgaaactttttctaatttgtcgtatgtttgatcattaatatttataagcaataaaaaattatcattaaataagattaaattataacttagcttctcattttcaaataaatataaattttcgtataatttatttatttgtgtttttattttaatactttcattttcaaatccattttggtaataaagattatcttgatcatcaattgttactgttaatgtttcattacctttaaataattgatatgttcctgatattttattaattacattaggtttatctgcatctattcctaatgagtatccgaaataaaaagacgaaagaagaaatactattaccactataacaattattttgtatttatttttcatatctattcctcctacaaaaaaattatactacgttatataacgataaatcaaataataaccttataatcatatttttttgactttatatagaaaaatgtgctagtttatattacaatatttatataagataatgctataataaatatttaaattatatgcgagatgaaaaagttatgaaatctattaaaattataatcgctctactaatgatttttgtttgtattcctgtttccaatatttctgcattagaaagtactgataatagcaatattattatatataccccaacagaagaagaatttagagcagctgaagaaatagaaattgcaaaaatgaaagcttattttgagcggacaaaagaatcatatgcttatgattatagaaaagttggtgaccctcaaacatcttcattttcaccatataaaaatgcttatgatcaaccagcaggaggtactatttttaattcggaaaatagcggtttctattggagtgatagttcaagaagtccaggaacatggtctttagggattagtattgctggaaaatatttatctgttgacgtagcatattctcctggtgtggtatcaggttctagtggtggagtatttgtaggcatatcatcaactcaagtaggtaaagctataaaattaaaagtagcaagaaattataaagttcaaaaatatgacgtatacagaaaaccacaatatggcggatcatggacgtatctctcttcatatggtgcacctacaaagtatcagagtcgatttattatagaataaaacaatgttatcatttataacattgtcaaaatatattatttatatagcattatcaaaataataacttgttaataaaaacagtttctaacaattgcataatcaaaaaaaggtataataagtgggtattatttatacgtatttataagtaaaaagttgtaccacagtggcacgactttttaacgctatgatttcattgttttagcctattgtatcgacgtttttcgagagggtggtctagggttcttgcgcctagaccaccctctctcgttatgtgaaaaaatcacatgctttcattattcctatagttacagctatagttttttcgtttgaaactgttggtatgtatagttttttatactttcgaaaatctaaaaaaatctctcgactacttatcttttttcacttctaatagttcagcggttcaagaacatttggtacaaaaaagttcgtaaaatacattacggacttttttgtaatgctttagattgcttagtatctgttctttttttattgcgtactcacagtccttgtttcgttgttctttgtttggagcgtttgagcatttaaaagcttgtagaagcgtttcatattctttgaggttcttttcagtactgatcttcattttgtcttttaatataaccacgttactcaaactcctttaaaaattcttccagttccatttgttcagggcagttcattggttcctgatgtacttctgttttaacatctatgacatcagcttttgactaccaattaaacgtaaataaaatcaaagttattgaatgactggttttcatttttatggctcatatgtacgtttgacttttcattgatttcttcttttgatttttttaaaacttttctttcaaacgtttcaaatctaagcattatttcttagtacttttttactgtaaaatacaaaaaaatacagtcaaaccttcacaaatagtattatatatgtatcaggaaatgatatctactttttttcaatcacaaaaatccagatatataaatactaatacttttgtaacgatattttattattaataaaattaacataatgttccattttttagaagattaaggcattttatagaggattattttatcataatgatgtgagaatttaataagcaaaataataaaaatgatgtaaaatcgttagaagattcatgaaataaacttctttctcattggaatttttgaagtaataactattggacaacagattaatcataaaaagaactatttataaactgtccaacttttgaaattcagttcatacttagttctttttctttgtctaaaaatgttaacaaatcagcataacggtttaactatatcagactagacaactatactatatctagagtggttacatattatgaatattgataaattcaaggcagtatttgatacaaagcaaaagaaaactatcactggtgttaggtaagtatagattttaatcttctcttacagttcaaaactactgatgaaactatcataatcttatactttaagactctttattttatttagtaagtacgaccctaattatcctaatgttgaagccattggtaaaacatcctcgtgtaaatggatatttaattcttcttaaatgtaattaattcttttttttattctctccacacacatttttggatatttcttttgaatcttttttttaaatgatggaatgttatctaactgtaacatcattccattttgaagaatacaggaggaattttcatatatggatgaagaaagcaaccgataaataccattttaaaaagtaacactaaatctatgtccgatcgaccaaaatcaatgtatagatctttttataaaatcccaatctatgtataaatctagtttacttacattatgttcctacggtactaactcttctattatactcattatgatattgtctttttgatactccgtcttgtcattaccatattttaccactctaatctacatcttaattatgccatttttttcaattttcctttatatataaaaagcaaaaagagtttcaaattttgcaaactaggacgaaatcatcttcttgcctttttattttatcatactctctttcctatgcaaataaaaaactattgatttgatacatgatgtactttatcaatagtctaggaagatataaaatatcctctttcaaagtttttcaagctattatttgtccagagagaatatagcaaaaattatctttctcctggtatattgtaattgatttttccataaaattacatatttttactataaaagcaacatccgtaattataatatgataaataatattgagatataaaataataaatctaaggaggatattatagtatggacggtatagcctatatgaattcgtatgcatttctagaaactctaaaaagtgttttaattgttgtggttttaatattattagttattctactgccaaaatgtatcatagctgtaaacaagtataataatttaaatgatacaaaagatactgaagttgatgtaaaaactgattaagtttaaactatttctcttttatactgttatttatcaaatgtgttgtctctcttgctttaactatgggagtataagacatgtccatcgaatttacgcaagtaattgaagatggacgaacagctattttgcatctacggtgagtgatgctccctcacaagtcattaaacaatacattgaaaaccaaaaatatctcaatggcaaaaggggattaaatttagaatctaccttaatatgaaacagcaaaatttaatcaatcagatactgggttgttacagactcatttacaaaaaagatcttgtcatgcgaagcaatcctatcagaccagttctaaaattggctacccacaaacttctgcaattctgacatacttaaaaaatttatgattttgcatttatttcttaaagtggtagattctatttctttacaacaattcttgtgtgatcttataattagagttataagcaaacaaaacttgaaaattttctaaagcattatctaatttaataacagtcctaatatttttttctttccacatttttataattttttgagtagcatactaatcaaataatatccctgccttaccttctaccagtgagtgagcaagagaaaaagcaaagtggagacttgtattaccttgctttttcgcagatcacgcaatactcttagacatatggaacttgttccatatacatacacactatttcaatttaatacatctttttcattaaaaacttcttcataggtataatataaaatagcacttatctttaatatcctgatgctctgacatcatttttatatgtgatgataaaagataattttttactttatatctttcagttataaaaatattacataaagaacatataaaattaactttatcttgatattttatatcagtaattatttttatagtctataatataagcaaaaatagaggggaacaaaatgaaaaaaatattacgcctatgtttagttcctttgatggcattaatgtcatcatcaaatttatttgcaatggagacacagcccatcacgcaggagtctgaaggattaacagctaattctgtaatttataatgttagttttagcaattataaattaacacctaaagaatatgtcatgtcaaacggtggaattagcatatttataaattctaccacttcattcccaaacgaaaccatatcatttgaattatttcacaatggaaacagaactggtaagattaaatctgtacctttgcagtctggtcagtatgtaagctggggtgacttccctgcaggcaattatgaaatccgtatcacaagttcaaaagcggactactataataatgtatacgtttctgcaacattacgtgttatatatggaaattaatgttactgttgactgatttgcttaaattttatgcctatagcgggaataacattattgtattcccctataggctgtttgtaataggcgtaattttgctaacagttatttttttcagagacaaaaaatactctattgtctggagttttgctgccaccacatatgtttctttactgttttgtgtgttgttttttccagtagtgatagatcccggtgataattataattttactaaagacatcagaaatatgataacattctataacccatactatagacttctatatcaaactgaatattctgtatgtcatctgattatgtttatacctttaggatatctcatcagatatgaaacaggattaataaaaagtatctttatatcccttcttatagtttttggaatcgaaaacctgcaaatatatataaactttttttgtggatatgttcaatacacctattgcatcgcagacatattgtttcattcaatcagcgctatgacagggatttgtacaaaccaattacctttatcagaaccagaataaaaaacactatagaaaaagaagatatacattatctgtaaataccggttatcataacgatagccttttctactgaaattttttttagaaaaggcagaccaagtccgaacaacagtacagtttgccgatacattgaaaatataattttctactttttatgggtaaatgtaccaaagtatcatatctgcctaagttatagattttctttttaagtgtgatttttacataccatttatttcttgttttatcataacaactaccactgtgaggatttttcagattgatccatcgttttaacatcggtgttatctattctaaactcattacgtttagtatttacttttttcatgtttttgctcattgtttccttttacaacttttaacttcacctcttgttatatttcttcaccgttgcttttatatacttttttcatatatgcaaatgactttttcttaaatcgtttcatatctcgcaaatcatcgtttgtacgattaacaaaaataaaaccatatctcttattcatatctccagaactacttaacatatcaaatggaccccaagtaatatacccaaaacaatctacaccatctagctcaattgcttttttcatttcaactaaatgatcatgatggaattttatacgataatcatcattaatctcattattatcgcataaatcttctagatgactataaccattttctaaaattaataatggtaactcatatctagtatacaaattagttaagttattacgtaatcccacaggatcaacttcccatccccaattagttatatctaaattttcatttctgacaatattcttttcaataacatcgtagaacggcttgtcttcttcaaaatcacctgttgtaagagtgtaagaacgataatatgatactcctaaaaaatcaactgtatatttcaatagttcttcatcaccctcttcaaattctggcatacaatgatgatttttaaaatatctaatcatgtattctggatatctccctttagtaaaaacatacccatgaaattgatgagtgtataaatctgctaacatacaaaacattgagttctctggtgttttatcatttggataaaaattcgttagtgcaatcattccacaaattttagcgtcatcataatattttctaatcatcttaatcgccttacaatgtgcaattaaaatattatgatttacttgatataaaaatttagaatagctcattcctactggcactacagttgctcccgcttttgtagtttcttttgcataatcattttgttcattaaaagtcatccaatatttaacgcgatcaccaaaagcctttacacatatctctgtaaacttttcaaaagcattgactactcttctagaaaaaaatccattgtatttttcttttaatggcaaaggtatatcataatgatctagcgttatcattggcgttattccgtgagctagtaattcatcaataacattattatagtaggcaattcctttttcatttatcttagtttcaccatctggttggattcttgcccagcataaagaaaaacgataaaagttaagacctaattcttccatcatagcaatatcttctttgtaacgatgataaaaatcaatcccatgatcccatttaggttctccattttcccttttatgtaaatcatacatacttaatccttttccatcttcataagctgctccttcagtttgaaaactagtaactgaaccgccccaaaagaaattatctggtaatttattcataatcttctccatgttctctacaacattaatatgtagttatattattaataattttggataaagcgagggttatacccctcttatttaattttcttcaatttggttatttagtgatttttctgacatttttaaaaatggtaaataaatcattaccccaataacaatcaatataatatggaaaacagccgctctaatatctccattagttgacaaaaatgctgatattactggaggagttgtccatggaatttgaacaacacatttttcaatcaaacctaatgatgtaacaatataagctaaaataaaatttatttgtgttactaatacaaacggtataatcataattgggttcattacaattggaaatccaaagataactggttcattaatattgaaaattcctggtgccacacctaaacttgcaatcattttatgatctctacgtttagagaatgcaaatactgcaataattaaacaaattgtacaaccagttccaccgattaaaccataaacttgtttaaacgaatcattaataatattttgagctggcaatcctgcttgaacggcatccatattttctgtaattgctagtaataaaccaggtccaataactgtatctacaattgctgaagggtgaatacctattgcaaacaataaattgaaaatagccattgcaatcaagaatcctggtaaactagtagttaatcctttaattggctgttgaataatatttacaactaattcattaaatgattgtccaaagaaacaatctaatacaaatgacaatactgcatagaataccactaccaacataaatggaatcatattatcaaaagactttgccaccataggtggtactgactctggcattttaattcttaaagctttaatttttgaaattactaagaatagctcagtggctgtaattccaacaactaagccagtaaacatcccagatacacctgtgtatgtttgagctaatatattagctattcctactgcttcgcttcctccaagtggtgttacactagttgtcaaaggaactaaagtcacaaaactacatagtgcaacaaatcctggaatcaatggttcttcagcacccttattttttgataaacagtaagcaacaccaactgttgaagcaactgcccaaatacctaatgttccatttgttacatgtgttccaacttcttgtgctttaactaaggtatttgtatttataatacttgataacactccatttggatccaaaatcaaactatttaacaataccataatgccagctaaaatagctaatggcattgttaatgcaacagaatcacgcattgatcttagatgtatttgattagcaagttttgaacttttctcaacaaacttatcaataaaattattcatattattctctccttttaatgtattttaaagtttaaacatcctaattcactcaactgttttttccacagttcttttaattcttctgatgtattttcttgataaaagtaactatctagattgatgttttcagcttttgctttccctaaattatgatatggaagaatctctatactagatacatacttagaataatgacttattgcttgaaaatggtccatattatcattaattttatggatgattggacaccttaaaattatatgtcttttattatcgattaaatattttaaattatctaagattaaggaagaatttgttttaagataatcataatatttttcttgatcacttaatttataatcatacagccagtaatcaacatattcctctattttttttatatactctaacggcactgcaccacttgtctcaacacataagcttattttctcgtctttacaaaattttgctaattcatatgcagcatcaatctgtaaaagtgcttctcctcctgaaagagtcacaccgccatttgtcttatgataatatttcatatctttcaaaataatccttttaatttcatcagtctcaactatcttaccatatgttttttttctaccatcctcttcatattcctgtatatcaaaacgatatgtttcaggattatggcaccatatacatcttaaacaacaccctttaaaaaatataactgtcctgatacctggaccatcatttaatgaacatctgtcaatattaacaattgtacaagttttcaaattaatataccatcctacttacgatttctttttggaccaagggtgataaatcaataaatctagcactgaatcccccaactctaacgattaaattaggatatttttctggatgtatcatcgcgtcttttaattcttcttggttaataacacttatcataatttgtgagccaccagatgaaaagtaaatttttaataactctttaaccatatctttatgttgattcatcaaatcatgacttaattttagattatagacagcacctgccatattattgacatctaagctactcactgtattcaatacagcagttacaccatttttttcagcaccactttgaggagttaatgcatttgctaacggttcataagcttttcttccatcaaaagttgctgctgttctatatcccaatcgtgaatttgcatcattatttataataactatcaaatatgaagataatccatatttttctgatttagattttgttgtgactgcaacatactgatttaattcattaatcatttcatctacttcaggattatcattaccatacttgataacattaaggcatttttctctaatctcttcatatccaataaagttatttctaattgcatcaaccatatctttataacgaatttctttatcatcaaagactaatttttttatggcatataaactatctccgctattcacattaccataggtttccaaagttccacctagatagtcaatcccaccatttaataagcttttacctctatcaatacagttatcataaagaatagaattaaataagtatccacaatgattattcatataatcatattcaaatttctcttgtttagctaacaaatcaatttgataatctaactcttgtttatatacatcatataattcttcaaatgtattaggttctttagttaaataatgctttactatttttttattagtaatcatacattttccatcattaaccaacccctctaataccttagctaaattaatgattccattaggtgaaccaatgcttttatgatccaaaacatattcaccacaaccaagaggaacataatcaaccgcttctttatatgatacattcattgattctttgacatttttaatattaaccgtgtcattgtataataatggataactacaaccactttctatacaatcaatcgcattatcaaaaatactatcaggcatatcttttgaccacctaagtgttaattgtggttcagttaaatgtaaatctttcataactttaagagctatactgcatatcttgtttgctttttcaagatcatgacgaccctctccacctaaaataatacgaccattgtaaatcgtatttcgttgtctaattaccttgaaatattctgcaatattcttatatgcatcttgttcatcatctaaaaaacgtgctaattgattatccattcttccatagtttctaatttcactaacgcctacataaatccacattaattgaatcgcttctttcatattttgtggtctatgttcaagtaattcatttaacgtataagccaattcaggattaatgtccatggcatcatcacgatacagttttattaattcttttaagtaaataagcgatttcttacaagctcttaaaaaactattgagtggttgagaatcaatttcatgaatcaatccatctattcctaaatcaaataatttttcaaaatcaagataagctcctcctaatctatataaaggatacgctgtataataatcattttcaaaatcatcatatggcattaattcttttatatcatttggataatatcttctaagacgttctttatcattctcatcagcccaaaacgtatacaattcttctaattcttctttttcaacatcatgtgtaccttcgattaattttgctaatcgttctaatttgcaattgtaaataaagttagtatttcttgatccaaaaccacaaattgcactaggaaaacatgataagaaataatcatcgctcgttatttttgtacgattttccttgtgcataaagaaatggcattctacttcccgattgtatttatcatgactattttctttatacaatctcgtaaactcttttaaatattgaatttcattcatttgtctacctccttttcatataaagagtatcataacaaggtatatcatacttaacatatattcgctttttaaactttattaaacaaagcattcattttatcttatttttctaactttatttttaattttatttaaatcaaaattataatataataaaaataatggaggtgctttatgcaagaactaagtctagaaatcatcaataacagcaaagatattcactggcaacaccgaaaaagaaaaaaatctgaagtaggaaaacattatcagacatattatgaaataacattaattattgatggtgaaatcaaaaatgatacaacatcaacatctaatattattaaaagaaatgacattattttaatgaaaaaaaatatttttcatgaacttgttactattaatgaaaatatttccttaaaatatatcaatttagctttttctgacaaaattatgaatagagttcagactatatttggaggttttcatttaattaatgatactgtaataggacacttatctgatgaaaaatctagaaaactaattaattactataatgatatcaatctcaacgattcttattatgagttaaataaagatatagaattgttcttatatcaaatgataaaagaattaatctatcatcaatcaaaagatacgaatatatatccaaattggtttaaatcattattattagaaatacaagatttaaataaaattaaagaaacaaaagatatttttatcatctcaccatattctaaacaatatacaattaaaaaatttcatgaatatttaaatatgactcctagccaatatttaaataaaaaaaaaaatagataaggcaatagaactccttttatctactgaattatcaattctaaatatagcttttgaatgtggatttaataatattgaatattttgataaaatattcaaaaaaacaatgggccttacaccactaagatacagacaaactcaaagtaaactcttaaaagaaatagaaacttaattctactgcattatttagaaattatatataaatttactgattactcaaattgtaccaattctaaaaattggaccaaaaatgatatgtgtctagaattcttgatacatatcatttgctggtccaacttagaagatttacttaatttgagcaagatttatttcttcaacttttaaacttatcgtaaatacaatattacattatttacctagttttaaactttctaactcatttaaatcatatggagtttcttgataaacgtaataatttaaccaattactaaataataaataagcatgagaacgccattttactaaaatttcattgtgcatatcatcatttttataataatttttaggcatagtagcttgatcagaaattgccagatcacgattatattctttatctaatgtatcaggatcatactcaggatgaccagttacaaaaaaacgtgagccatctttttctgcaatcaaataaacccctgcttcatcgctagcagctaaaatatcaagactagaaatcgttgctatatcttctgccataattgttgtataacgtgaatgaggagcataaaattgataatcaaagcctctaagtatctttcgcttcattttatcaacattagtatgatgaaaataaacacctgtcagtttttcttttaattcatgtttctcaataccataaaaataatgcaatgctgcttgagaagcccaacaaataaaaaatgagctaaatacatgagtttttgaccattctaaaatcttttccatctctaaccagtaatcaacatcttcaaacctaagtttttccaccggtgctccagtaataatcaaaccatcatatttattatcttttatttcctcaaatgtcttataaaaagctaataagtgttcttgaggtgtgtttttagattcatgactggccatatgaatccagtctacctcgatttgaagtggtgtattcgacagcatccttaaaagctgtgtttcagttactactttagtcggcataatatttaaaattaataattgcaatggcctaatttgttgagctaaagcacgattttcatccatcacaaagatattttcttcttttaatattttacttgctggtaaatcatttggtattttaataggcatatttaaacctccctaataatgattagtttaccacatctattctaataatttaagtaaaaataataaatccattgaatttcttcaatggattaaaatgaaataagctcattaaatatttgaataatataggcatctgacattcctgataaataatctaaaatgcttttaataattgctttatcatcattaataaaatcataaataactttattttgataaagcgaatcacgttttgctccattcatcacactatatttttcaagccaatggataaatccattgattgcatggggaaattgatctttatccttagaaatttcatcaataatattagtattactatctcgagccattaaatcgtatttaataaagaaatcaaaaatagaatttaaaatcaatttaacataattagtatgaatttgtactctatcaattaaatatatattttgataattaaacttcataattgttttcattatttcaaaagcttcttttgataatgaaattccatcgcttggattactatgactgcatacatcttgaataaaataattaacgacagttccattattgattgctgtaaaatgatattcactagtaatattattgagcgaagctttcaagacttcaactttattctcttttagtaccttgagacgtaaagcgtcttcaatatcacgtgctaaataggcaatcttatctgccatttttacaacacatccttcccaagtataaggactgtattgtcctgggctagtataattttgtaaatcaatatactcatctcgctttttaatactcatttgattcatttctccacaatgagaaataattccatcacgaatagcatatgtcaaatttaaattatggcgatgatgttcattatcttctaatgtttctatttcatcaatgagatgaagactattgcgctcatgccaaaaagaatcgagcccatgtattttagcaagctcgttaataatacgttcaccaccatgaccaaatggggcatgtcctaaatcatggcctactgctattgctttagttaattcagtattcaaacctaagtaatttgcaattgtataacttacagattcaactaagttaacatgttcactacgtgtacaaacatgatcatccttaactgcaaaaaacacctgtgtcttatgttttaaacgtcggtatgcctgagaaaagataattctcgtataatcacgaccaaactcactacgtagatcattacttctttgatacaatggttcaagtcttgatattgcttttgagtagtttggatttgtttcattcatcgctacttctttaaataaattttttgtcatatttagtacccccatataataattatacgttatttatcttacgtaaacaaattaaacacatttctttaaaggtaaaaaaaaggttttaaaaaaggaaagatttataaatctttccttttattatttagttaataaactagcagctgctttatcaacaattacaacaacatcattatgatcttgaagtgcacttgctggtacgtctgtagttttttcaccttcaaccaatactttgattggttgagctttattttcaccacacgcaactaataatacttttttagcttgtaaaatatttgaaattcccatagtaatcgcatgagtaggtacttcatcaattttcccatcaaagaataaacgggcattatcttgacgtgtactttcttttaattcaatcatatgagttactgaatcaaaagaagttcctggttcattaaaaccaatatgtccatttgaaccaattcctaacaattggatatcgataggattttcagctaataatttattgtaatcatcacaacttacttgaatatctccagcaccatttggtacatgtacattttcaggattaatgtcaattccagagaataaatgtttattcataaaataatgataactttgtggatgagtagcttctaatccaaaatattcatctaagttaaatgatttgatatctttataagaagtcccgttcttcttgtgatcttcgatcatcaattcatacattctgattggtgtagatcccgtagccaatcccaaattagcagttggattgtttttaacaacttctaacataacttttgcagcttcaatgcttgcttcttcataattttcaactataattaatttcattttgtgtccctccacttatatgatactatttttaccttaaaacttcaagttaaaggccggaaatatcaatcatttttcaaaactcgaaaaaaacgagtcatgtattttttgtcaaagtctattaatttgtaagtcccttttgaaagcccttttttcataacgcgaaaatacctagtcacagttcgatatttctttattttttgctaaaaataaggtaaaataggaatgtatatggaggtgtttttaatatgataaaaggtattggggcatctagtggtatcgcgattgctaaagcatacaaactagtaatgccggatttaacagtgacaaaagtaacagtagaagatgctgaggcagaaatcaaaaaatttgacgatgcaatgtcacaaactgcaaaagaattagaatcaattaaggaagctgctgctaaaaatttatctgcagaagaagctgctgtatttgatgctcatgcattagtattacaagatcctgaattaaaaactcaagtagaggataaaatcagaaatgaaaagattaacgctgatgctgctctagatgaagttgctaatacttttattgcaatgtttgaaagtatggatgatgattattttagagaaagagcggctgatatcaaagacgtatctcgtcgtttattagctaacttactaggtaagtcattgccaaatcctgctttaatcgatgaagaagttgttattattgctgatgacttaactccatctgatactgcgcaattaaataaaaacttagttagaggatttgctactaatattggtggtagaacttctcactcagcaatcatggcgcgttcattagaaattcctgcggttgtttcttgtaaaacaataactgatgaaactaatgatgctgatatggttgttttagatggtgaagctggtattgtaattattaatcctagtgatgatgaaattaaagaatatcaagctaaacgtgaagcattcatcgcatacaaggaagaattaaagaaaatgaaaaatgaaaaatctgttactctagatgatcatcacgtcgaactagttgctaatattggatctccaaaagacatccaaggtgtactagacaatggcggtgaaggagttgggttattcagaactgaattcttatatatggaatctgctcaattaccaactgaagaagaacaattcaatgtttataaagaggttcttgaaggattagaaggaaaacctgctgttgttcgtactttagatattggtggagataaagaaatcgaagcaattgatttacctaaagagatgaatccattcttaggagttagagcggttcgtttatgtttccaaagagaagacatctttagagttcaattaagagcattacttagagcttcagtatatggtgatttaagaattatgttcccaatgattgctactttagatgaatttagaaaagctaaaggaatcttaatggaagaaaaagaaaaattaattagtgaaggaatcgaagtatctgatacattacaagtaggtatcatgattgaaattccagctgcagcagtgttagctgatcaatttgccaaagaagttgatttcttctcaattggtacaaacgatttagttcaatacacatttgctgctgatagaatgtcatctggggtttcttatttatatcaaccattccacccatcaatcttacgtttagttaaacatgtaattgattcagcccatgccgaaggtaaatggacaggtatgtgtggagaaatggctggagaagcaattgctgcaccactactaatcggtttaggactagatgaattctctatgtctgctacatctattctttctcaaagaaagttaatcagatcaatgaaaaaatctgaaatgaatgaattagctgctaaagctattaactgtggaactatggaagaagtagttgcattagttaaagaagcagttgaaatataaaacataaaaatcgaaggtcaaataaagtgaccttctttttttctaaatattcccatcttagaatttattattaaagccggatataaaataaaaaaaggatacgcagaggtatccgtaaataaaaaaagaaccggcagcttgctattgtcgcaccttggtactatcttcgccgttatgatgcttaacttctgtgttcggtatgggaacaggtgtgtccatcatgctatcgctaccagatcttcttttctaagcaattcctttcgagaatcactcaaaactagataatagttttcttgcgtcttttgtcttccactttgtcttctttcagtttcaagccttaaccctttttctctaggttaagtcctcgacctattagtatcagtccgctgaacatgtcgccatgcttacactcctgacctatcaaccttatcgtctttaaggggtcttacttacttgcgtaatgggaagtctcatcttgaagtgggtttcacacttagatgccttcagcgtttatcccttccatatttagctacccagctgtgccactggcgtgacaactggtgcaccattgatatgtccatcccggtcctctcgtactgaggacagatcttctcaaacttcctacgcccacgacagatagggaccgaactgtctcacgacgttctgaacccagctcgcgtaccgctttaatgggcgaacagcccaacccttggaaccgacttcagctccaggatgcgatgagccgacatcgaggtgccaaacctccccgtcgatgtgaactcttgggggagatcagcctgttatccccagggtagcttttatccgttgagcgacggcctttccattcagcaccgccggatcactaagcccgactttcgtccctgctcgacttgtaggtctcgcagtcaaacacccttatgcctttgcactctgcgcttgatttccatccaagctgagggtatctttgggcgcctccgttactctttgggaggcgaccgccccagtcaaactgcccacctgacactgtcccgttgccagttccatggcatccggttagaactccaatacaagaagagtagtatcccaacattgactcctcacacactggcgtgcatgtctctcagtctcctacctatcctgtacatcttgcatcaaagtccaatatcaagctacagtaaagctccatggggtctttccgtctagtcgcgggtaacctgcatcttcacaggtactaagacttcaccgagtctacagctgagacagcgcccaaatcgttacgcctttcgtgcgggtcagaacttacctgacaaggaatttcgctaccttaggaccgttatagttacggccgccgtttactggggcttcaattcaatgcttcgcttgcgctgacacatcctcttaaccttccagcaccgggcaggcgtcaccccatatacgtcgtctttcgacttagcatagagctgtgtttttggtaaacagtcgcttgggccgtttcactgcggctcatatctctatgagcactccttatccctaagttacggagtcattttgcagagttccttagctatagttctctcgctcaccttaggattctctcctcacccatgtgtgtccattttcggtacgggttactgtatgattatcactagaagcttttcttggaagctggcttcacggacttctgtacttgccgcagctttccatacgcctcacgcctttgcctttcgacagccggatttgcctggctgtcggctacctcgcttgcacctgcatttccatcagcaggatccgctagccttctccgtcactccatcattcataccgtaagtacaggaatctctacctgttgtccatcgactacgcctctcggcctcgccttaggtcccgacttacccagagcggacgaaccttcctctggaaaccttgggttttcggtgcgtgggattctcacccacgtttcgctactcacaccggcattctctcttctatgcgctccacggctccttacggtaccgcttctccgcacatagaacgctcccctaccactcacgcttacgcgtaaatccatagcttcggtaatatacttagccccggtaaattatcggcgcagagtcattcgactagtgagctgttacgcactctttaaaggatggctgcttctgagccaacctcctagttgtctggacatctccacatccttttccacttagtatatattttgggaccttagctgatggtctgggctgtttcccttttgacaatggaccttatcacccactgtctgactgccgagtatatctttgtgacattcggagtttgattatgttcagtaccccgagatggggccatcacatattcagtgctctaccttcacacgactttacctcgacgctagccctaaagctatttcggggagaaccagctatctccgagttcgattggaatttcacccctagccacaactcatccgccaacgtttcaacgggggtcggttcggtcctccatcgggttttaccccaacttcaacctggtcatggctagatcactcggtttcgggtctacgacatgcaactttcgccctattaagactcgctttcgcttcggctccgcatatcctgcttaacctcgctccatatcgtaactcgccggttcattctacaaaaggcacgctatcaccctttaacgggctctaacttcttgtaagcatatggtttcaggttctatttcactcccctcccggggttcttttcacctttccctcacggtactggttcactatcggtcacagaggagtatttagccttaccagatggtcctggtggattccgacaggattcctcgtgtcccgccgtactcaggtgctgtctcgtgcttcttcactatttcggctacggggctgtcaccctgtttcgccggacttcccattccgttcgcctataatgatttcttgctctttgccgacagtcctacaaccccgatcctaagatcggtttgggctcttcccctttcgctcgccgctacttagggaatcattcgtttattttctcttccttcaggtacttagatgtttcagttccctgagtctcgcctctctgaagctatttattcacttcaggatacctggtctctactccaggtgggttcccccattcggacatcgacggatcgttgcatgcttactgctaaccgtcgcatttcgctgtttgctgcgtccttcttcgcctctctgtgcctaggcatccgccatacgctctttcttactttacctattttggtgtttgcttgattactattttcaactatttactaaaatccatccatccgtttcgatttatgttttttagtgatgaaaattcttagttttcgacttttctagaaagacctcaataataacaattactatttcgatctcattttctatttctatcgcaatttattttctattatccagttttcaatgatctctgagtcatacctgagtatcactcaaaactaaacagtatcttcgaaacatcacttctcttgtgcatcatcttcgatcatgcgtttctccttagaaaggaggtgatccatccccacgttcccgtagggataccttgttacgacttcaccccaatcatcaatcccaccttagacagctccttccttgcggttaggccaccggcttcgggtgttatcaactctcgtggtgtgacgggcggtgtgtacaaggcccgagaacgtattcaccgcgacatgctgattcgcgattactagcgattccaacttcatgtagtcgagttgcagactacaatccgaactgagaatggttttatgggttttgcttcacctcgcggcttcgcttccctctgcaccatccattgtagcacgtgtgtagcccaggtcataaggggcatgatgatttgacgtcatccccgccttcctccagcttgtcactggcagtctcgctagagtccccaacttaatgatggtaactaacgataagggttgcgctcgttgcgggacttaacccaacatctcacgacacgagctgacgacaaccatgcaccacctgtatctcatatagctatctctccatctctggagcctttatgagtatgtcaagacctggtaaggttcttcgcgttgcttcgaattaaaccacatgctccaccgcttgtgcgggcccccgtcaattcctttgagtttcattcttgcgaacgtactactcaggcggagtacttattgcgttaactgcagcactgaactttgacatccaacacttagtactcatcgtttacggcgtggactactagggtatctaatcctatttgctccccacgctttcgggactgagcgtcagttgcaggccagatcgtcgccttcgccactggtgttcctccatatatctacgcatttcaccgctacacatggaattccacgatcctctcctgcactctagctgcctggtttctatggcttactgaagttaagcttcaggctttcaccacagacccttgctgccgcctgctccctctttacgcccaataattccggataacgcttgccacctacgtattaccgcggctgctggcacgtagttagccgtggctttctaataaagtaccgtcactcggctaccatttcctgtagccgccgttcttcctttataacagaagtttacaatccgaaaaccttcttccttcacgcggcgttgctcggtcagggtttcccccattgccgaaaattccctactgctgcctcccgtaggagtctgggccgtgtctcagtcccagtgtggccggtcaccctctcaggtcggctacgcatcgtcgccttggtgggccgttaccccgccaaccagctaatgcgccataagtccatcctctaccagtgctttgaggcacttttaatacggtcaccatgcagtgtccgtacctatgcggtcttagctatcgtttccaatagttatccccctgtctagggcaggttacttatgtattactcacccgttcgccactcgagcacaagtgctcgcgttcgacttgcatgtattaggcacgccgccagcgttcatcctgagccaggatcaaactctccattgtttatttaaacaactcttcgtttgtttagctcttttttcttttttatccttctggatattgacgtgtgtttcttaattctgtttagttttcaatgatctctccggcttcttttgccgacttgaatatcttacactcttttcgctttttagtcaatcttttttttaactttttttgctttttctctccggtccttacgtccctttcctcgagtgcctatttaatttaccatatctcttttgtcttgtaaagccttttttgtctttttttgtaaaaaaatataaaatcaataagtttactcaatttgttaataaaataactcattactatctaagataattgtcactggcccatcattaatcaatgatacctccatcattgctccaaatactcctcgttccacattaattcccttttcttctaactttttattaaaaaaatcataaagcggactagaaatatctggtttagcagcatcgataaaacttggtcttcgtccttttttacaattagcatataatgtgaactgtgaaattgataaaacacttcctcctacatctaataaagatagatttaatttatcattttcatcttcaaatattctcaaattcactaatttatcaaccatcttttcaactaataactcgtcatcgccattagttatcccaactaaaaccatatatcctttatcaatagctcctacaatttctccttcaatcttaacactactttgactaactttctgtacaactaatctcattttaatccacctatctttcaatctttaaaaatgttataattattataactgattttaaaaacgaaaggaagataatatgtcatcaacccttgccaatagaatgcgacctcaaaatttaaaagatataatcggacaacaacatttagttggaccaaatgctattttaactaaatttgttcaaaaaagtcatccattttcaattattttatacggtagccccggctgtggcaaaacaacaattgcaatggcccttgcaaatgatcttgacattccatatcgcatcttcaacgcttcaaccggaaataaaaaagaaatggatgcaattattgaagaagctaagttaagtggtagtctttttgtaatcattgatgaagttcatcgacttaataaagcgcgccaagatgatcttctttcacacatggaaagtggattattaatagtcgctggatgtactacagccaacccatttcattcaattaatccagcgattcgttctcgttgtcatattctcgaagttagacctttaactgttgatgaaattgtagctggtttaaataaggcaatgacttcaccaaatggtttaaacagcaaatatacgattgaaaaagaagcattgcatagtattgcaaaattatgtagtggcgatattcgctatggttataactgtttagaaatttgtacaattgtttgtgaaaataatcatattactcaagctgatttgaaaactgctgctattaaaactaatgttgtctatgataaagacgaagataattactacgatacattaagtggtttgcaaaaatcaatccgtggtagtgatcctaatggtgctatgtattattttgctaaactgattgaatcaaaagatattgaatctttagaacggcgacttatcacaactgcttatgaagatattggtttagccaatccaaatgcgtgtatgcgtacggtaattgctatgcaagccgctaaaacaatcggttttccagaagctcgaattcctattgctagtgcaattatcgatttatgtttatcaccaaaatcaaaatctagtgaaaatgcaattgatgctgcgttaacttcactaaatgaacgttctttaaaaaccccttcttacttacgtcttacgccggttggtttagaagatgatgaaaagtatgattatagtcggccagaattgtgggaatatattcagtatcttccaaaagaactaggaaatacacagttctatgtaccatggatgaccagtaattatgaaaaagctttagctgagaattatcgaagaattttgaaacacgggcgtaccagtgatataaaaaaactaaatcaacaaaataagtaataaaaattgacatttgcgtgcagtaaaggtagacttatttatatagaaagggagctcgtatgcgggctgagaggaagtaatctaacttcgacctgtataacctgatttgggtaatgccaacgtagggatctagccactatttttgtttatgttcggtttgaacctattttggtccaaacctttttctatacaaaaaaagaatggagataaaaaatgaattacacaacacaaatgaatgcagcaaaaaagggaatcattactcctgaaatgaaaattgttgcggctaaagagaaaatgaatattgaagaattgaagacactaatagcccaaggaaaagttgttatcccagccaataagtatcatacctgtattaatgtaaatgggattggttcaatgcttaaaacaaaaattaatgtaaatcttggaacttctagagactggaaagatttagatatggaacttaaaaaagctaatgatgctgtcaatatgggagttgaatcaataatggatttaagttcatatggcgatactcaaaaattccgtcgcaaattaaccaaagaatgtcccgcaataattggaacagtgccaatctacgatgctgtagtttattatcataagcccttaaaagaaattactgctcgacaatggatcgatattgttgagatgcatgctcgcgacggagtagattttatgacaattcatgtaggaattaataaaaatacagctcaacgttttaaagaaaataagcgtcttactaatatcgtttctcgaggcggttcaattatttttgcttggatggaaatgactggtcaagaaaatcctttttatgaatactatgatgaaatccttgatatttgtcaaaaatatgatgtaacaataagtttaggtgatgcttgccgtcctggttcaatcgaagatgctggcgatataagtcaaattgaagaattggtgactttgggagaacttacaaaacgtgcatggcaaaaagatgttcaagtaattgttgagggtccaggtcacatggctttaaatcaaatcgaagctaatataaaaattcaacaaaccatttgccagggagccccattttatgttcttggtccactagttactgatattgccccaggttatgaccatatcacagctgcaattggcggtgcattggctgccgctaatggtgctgcttttctatgttatgtaactcctgctgaacatcttcgtctccctgatctaaatgatgttaaagaaggaatcatcgcatctaaaattgcagcacatgctgccgatattgcgaaaggtatcaaaggggcaaaagatttggactaccaaatgagttgtgccagaaaaaatttagactgggaaaaaatgtttgaattagccattgatcctaaaaaagcacgtacataccgccaacaagcaaaacctgaaaaagaagatacttgcagtatgtgcggtaatttctgtgctataaaaaatatgaatcgaattttaaatggagaaattgttaatatttatgatgaataaaaaagtcgtctgtttccagacggcttttaatatataaagagtaataaaaattcaactattttagcatttagattatgctgtcgcaagataaaattactaatcatttctagtgaacaattagtgctaactaatgtatgaacaccatttgcagaacttccaattgcaacataaccatgagccatacccccaattgcgagtttggaggcaattgccatacctccaattgcatagattcctattgccattccacctacagcaaaatagccaatacttagccctcctaagctaattccccctatagcaattcctgctaatgtcaataaaccaattgccagaccgccaagactaaatacaccaagtgctaaagccccaaaactaaaaagccctaccgcaatattgccaattgcaataattcctttcgcaattctaaaaccacgacctaaattaatatgaattaatggaacatttccaattttaaatttactcttatattcataagtaaagagatgacgcactacacttctcaattcttcacggtcaactgtaacataatcattactttcatgtctaattaattcatctaaagatataccaaatagatcagcaatttcaattattcgttctaattcaggtgtagattgacctgattcccacttacttaccgattgtctcgatactcctaaccgaaaagctaattcctcttgcgacaatcccttttgttttcgatatttatttaagttgtcattaaacatcatttatttcttcctcctgacaaccatgattatagtttttttattccaaatcacaataaactacggctaggcaatctgtcaactaacagttgcataaacaataaaagggtataattacccttctaattcactgataactgcattaatcgtctcattaaaattatttagattcacattaaaccaaataaccggaacttgattattaaaccaagtatattgacgctttgcataattacgagaattcttttttatcaactccaaagtttcatcaagtgtttgagttccctgataataagcaaaccattccttgtacccgattgctttcatgctttgcatttcacgggtataattctttttcattaagccatctatttcttgaagcaatccctgctccatcatcaaatcaacacgttgatcgatccgctgatataaactttcacgttctaatgtcagcccaataaatttagcattataaattaattcatgattttgtttggcaagtgtttcacttttttttacccctgtactttcataaattgcaattgctcttaagacccgttgacgattattaggatgaagctctttagcacttgctttatcaatctcaattaaataattgtataactcttcatttgaataatcttgatacttctcaacatattcttgatgattagtttgactttcactaaattcataatcataaagtgctgctttaatatataatcctgtaccacctacaataatcggcaatttaccacgtgatattatttcttttatttttaaacgaacttcatcttgaaaatcttttacactatagctttcagttggttccttaacatcaatcaaatgatgaacaataccttccatttcatcatctgttactttagccgttccaatatccattgttttatatatttgcatcgaatcaccgctaatcacttcgccattaaaatgcttagctagagcaacgcccatcctagtttttccaaccccagtcggaccaactacaacaataactttctccattacacgaccctcttaaataacttttcaatttcataagttgaataatatataattgttggtcttccatgcggacaaacgtatggattatcacaacgcattaaattatcaataatattttgcatcccctcggttgataaatgtgtatttgcttttaatgaagctttacaactaagcgtagcaattgcatgatcttgtaatttgatgacatcgattttattatcatttaataactgcgtcatcatatcttcaataaatacttgctcatcaatattttgcatccataacggtaattgctttattacataaccgctattaccaaaaacctcaagattaattccaactttagtcaataagtctttcctttcctcaataatcaaaaattcacttaaaggatattcaagtgtgatcggtactaataaatcccgcattgatagatcaagattttgatatttttccaaaaaatactcataattgattctttcttgcccagcatgctgatcaacaatatacattcctgtttcatcttcacaaattatatatgtaccatgaacctgtcctttaacaaataacttctttttcattaatttttcacgtggctcaacttttgtctcaataatttgttgatcggggataatgtattcactagtttcttccttaacaaaagtaaaatcatcgaaagatgcgtctttaaaaacaacttcttgatcattttgaggaaaatcagcttcaaatcgtggttgctctattgttttaatgggtactgactcataagttaaatcaagactaggttgttccaaattcaaaggcgccttagtttttttatattcagcggtcgcatcgtaagtcaaattaacttttgcaagagcatcactaacaccttgataaattaattcacgtaattgactttctttagaaaaacgtacctccagctttgagggatgcacattaacatctactaaataaggatctatttcaatattaacaatcgcaattggataacgtttatcagctaaatatcgacgatatgcattattaatactatcaacactcactttatttttaactacccgtgaatttaccattgtcaccatatgattcttactagcacgattcacatcaatttttgaaacataacccgtcacatgaaattcatcatcttcaaaatccactggaatcattgctttggcaacatttaatccataaatgttcgagataacttccaacaaattaccatttccattggtcttataaattgttctgccattatgaactaacataaaagcaatgtgcggatgagataaagatagccgttccaaatatgtttgaatattagcaaactcagcattagtcgattttatatattttaatcgagctgggacattttgaaataatttttcaactttgatattagtcccttttttactatcactttcattacactcaacaaagcgtccatattcataagtaacagttgtccctgttcctcctgtactcgttttcaattcaaaattactaattgaagcaatcgaaggaattgcttcacctctaaaccctaaagtttgaatgcaaaacaaatcttgatcatctttgattttactagtagcatgacgtgaaaaacatagtaaggcatcttctttgaccattccctcaccattatcaattatttgaatcaagtttaatccaccttcttcaataatcacatctatcttcgtactgtttgcatcaatactattttcgactagttctttaactacatttgccggtctttcaatcacctcaccagcagcgattttattagccaatacatcatctagctgtcttattttttgcaaatatatcacctacttttcatttaatttctttaattcaatcaatgttgataaagcatcaattggtgaaagcgccattggatcaataccttctaaatatttttccactacacttacggttactggtggagcttcttttaaagtatcatcgcttaaatgatgctcaatattattttcctctaaagcttctaatagtacattagcacgatttaatactgcatctggtaattttgctaatttagcaacattgacaccataagatttatttgaccgtcctggtttgatacggtataaaaagacaagatcatcattttcaattgaagcactagcatggacatttttaattccaagattcttttcttctaagaatgttaattcatgataatgagttgaaaataatgtaatacacttaatctttgcagcgatatactcgatcatagcttgagcaattgccatcccatcaaaagttgcagtccctcgacctatctcatcaaaaataatcaatgaattttctgttgcaaagcgtaaagcattattagcttctaacatttcaaccataaaagttgactgcccggaaattaaatcatcactagccccgattcgagtaaaaatttgatcaaaaattggaatacaagcttcgctacatggaacaaaacaccctatttgtcccatcagtgcaattaaagcaatcgttcgcatataagtcgatttaccacccatattaggtcctgtaatcaacatcactggattagcagcatcaatatttacatcattcgaaacatatgttccttgtgccataacccgttcaattacgccatgacgaccatcaactactttaaacactttattatgattgaaagttggccgaacataactattctcactagaaatcattgctaatgattgaaaaacatcaattttagcaataattttagcaacatcctgaatagcatgaacatctttttttatgtaatttctaatttctgtaaataatgcatattctagttttatcattttatcttgtgcactaagtaattttgattccatctcttttaattctggtgtcacaaaacgttcagcattagataaactttgtttacgagtataattaaattcatctttaactaatgatagatttcctttagtcacttcaatataatatccaaagacacggttatatcctacttttaatccttttattcctgttttatcacgctcattttgctcaaattgagctaaccactgtttaccatgatcacggatataacgaagttcatcaagttcttcattaaatccttccttgattaaatttccttcttttacagttaatggcggattatcaacaattgcttgatcaatcaaattagtaatgtgacttaaatcagtaaaatgatctgccaaggcactaattaaaggttcatctaacgataataattgattttttaattctggaactacttttaaggaactgctaatccactttagatcacgagcattaatatttccaaaagcaattcgtgaagatagtctttcaagatcgtaaatatctttcagaatttctttaatactttctcgttgaataaaatgattagtaaagatctctacgatatccaaacgttcttctatttgttcttgattaattagaggtcgttcgatccattgttttaacatccgtgatcccattgctgttttagtttgatctaaaagccaaaatagacttccatatttatcattacttttagcactactcgtcagttctaaagctttttttgtataaagatccattgtcacataatcttcattattaatttcttcaattatctgtaaatgttccaattctcttttttgtgtatctaataaataattaagcagtaatgacgctgttttaatttgttttaaatcattgattttgctaaaaatcttatcatacttttcattataattatcgtgtgcaaatggtgaagataaaatatcatcaaattcacgtatttgatttggtaaagtgacaatttccttaactgccattgtttctagctgattcaataataatttctctttcttttcaatattgaccacactaaattcgccggttgtgatatcacaaaaagctaaagtataagtaaaatcaaattcttctaaggcagcaatataattgtttttattatttgtcagagattcatcaaagatagttcctggagtaatgatctgtaccaccccacgttctacgattcctcgtttcccaggttctgttaactgttcaacaatcgcaacccgatgtccattatcaactaatttttgaatatatccactagccgaatggaaaggtaccccacacattggaacccgttcaggagctccagcatttttccctgttaaagcaatttctaattctttagaaaccattatggcatcgtcaaagaacatttcatagaaatcccctaatctaaacataacgattgaatcttgattttcttcttttattgataaatattgcatcatcattggactatattttggtttcatcaattaacctcacttctaaaaaattactatcacattataacacaagtaacctcaaaagaaaaaaggcttccgcctttatttgataaaattttcatcgactgttaaattttctaattcatcccatgtctcattctctgctttagtttctactcgcattgttgttttaccaacaacacttaatgagatttctttttcaatctcaatgacaactttatcttccaacttatttacactaatacattttggttcacgattacaggtaaccattaattcatcaccctcatcaaaatttcgggtttcttttttcactaaatctaattcgtttaagtagcttacagtttgcttcaatagactactatcatcattgatactgtaccatagatgaacgtcaaaagttcccaaaacaacaggtttcccatctttaaaagctgcgttataacgatggttagtaatccaacaccctagaattttgtcatatccttcaatcgaaaacggatatttattaagggttctttttttccctttagcaattactgcctgagtaatgatttcacgaatattatttgccatgttctcacctattttaatatatgttggaaattaaaaaaaatgaacaaaaaaacgcgaattaatcgcgttttagttttgatgtccatttccagatgtagaatcttttaaaactacatcatgtgcgccaccttcaacaatactagttgaggaaacaagcgtaatttttgctttctcttgtaattctggaatagttaaggctccacagttacacattgttgacttgattttacttaaagttaaaccaacattatcttttaagctaccggcatatggtacatatgagtcaactccttcttcaaaagaaagtttagaatcaccacccatatcataacgttgccagttacgagcacgagcagaaccttcaccccagtattccttcatatactgaccgttgatactaactttattagttggagattcatcaaatcttgagaaatatctacctaacatgatgaaatcagaacccatagctaaagccaatgtcatatggtaatcatgaacgatcccaccgtcagagcagattggaatataaattcctgtttctttaaaatattcatcacgtgctttagcaacttcaattgtagccgttgcttgcccacgaccaattcctttttgttcacgagtgatacagattgatccaccaccaataccaatcttaacaaaatctgctccagattcagctaaaaatctaaaaccatccgcatcaacaacattaccagctccaactttaacgctatcaccataatgttctctgatccagtcaatcgtaattttttgccattctgtaaagccttctgatgaatcaatacataaaacatcagcacctgcttctactaaagccggtacacgttcggcaaaatcacgagtattgattccagcgcctaccacataacgtttcgaatcatctaatagttcgtttgggtttgattttcttgtttcatagtcttttctaaagacaaaatatgctaatttttgatcatcatcaataataggtaaagcatttaacttattatcccaaataagatcatttgcttcttttaaagtaattccaatgtgcccacagattaatttatcatatggtgtcatgaactcagttacttttgtatctaaatccattctagaaactcggtaatctctgcctgttacgattcctaataattttccattggcactaccatcctcagttactgccattgttgaatgtccagttttctcttttaaagcaattacatctgcaagtgtatcactaatacttaaattagagtcacttggaacaaatcctgctttataagttttagctcgtttaaccatagctgcttgatcttcaatcgtttgtgatccataaataaatgaaaccccaccctctcttgcaagagctactgccattttatcatcagatacagcttgcattaccgctgaaactaggggaatatttaatgataacgcaggttcttcaccttttttaaatttaactaatggtgtctttaagctaacatttttagcttgacactcagcagatgaatatccaggtactaaaagatattcattaaatgtgcgtgatggttcatcaaaaaaatatgccattttctatctccttttctatgtcgttttgtgtaatatttcataaattataattaggatcaatcgttaagtcaagccctattttaataattgtccgtttatatatgtatttatcgattgcaaaagactatctacttcttccttcaagtataaataattaacaactaatggatgattctcaaattcatctttaattttttgatattcttcaattgttttaacaactgtttcatcttgttttgacttttgatttacaatcttcttttgatatgctttcatctttgcttcaagtttttctatcttatcatcctgatgaattagctgctcatacttttgatattctttaatgacatcaagattcaataaatatttatttaactgtttagcacaatccaaactacgattcaattgattcacctttcaaagcccatgttttggcttcagttatttttactttaataatttttccaatatctttaggatcacctttaaagtttaccaatttttgatgccgagtatacccagtcaacattgaatcatccttcttagatgttccttcaactaatacttcgacaatcttatttaagaaacgttgattttgcttatacgctttttcattaacgatttcattcaatttatataatcgttggtctttttcatcacttgctacattatcaaccattttcgcggctggtgttcctgcccgaggtgagtagacaaatgtataagctaaatcatattcacactcttgatataaagacaatgtatctagatattgttcatgagtttcatttggaaaccccacgataatatctgtcgtgactgtgcagtcaggaatatattctttgatcttatggaataattctagatattgttcacgactataacggcgccccatcaactttaatacttcattattccccgattgaactggtaaatgaattgccggcatgatattatcatatttcgcaataattttgatcatatcttcactaaaatcccaaggatgactcgttgtaaaacgaattcgtggaatatttgttttagcgacatcctcaagtaagtttgagaaattataatcctcacctaaatctttaccataactgttaacattttgcccaagaagcgttatttcttgatagccttcagcaaccagttcttcaacttctttgataatatcttttgctaaacgagaacgttcttttccacgtgtataaggaacgatacaataagtacaaaatttattacatccatacatgatatttacccatgctttatacttgttgtcccgtctaactggtgcattttcaattacatcgccctctttagaccaaacttcaacaatcatctctttactataaagtgcatcttttaataactcaggtaatcgatgtatgttgtgagtaccaaaaatcaaatcaacatggggatgcttttccaatatccgattaacaacaacctcttcttgagccatacatccacacattgcgaaaattagatttggattagtcttctttaaatttttgacatatccaacttttccaaataccttttcttcggcattttcacgaattgcacaagtatttaaaacaatcacgtcagcctctttaatttctgtagtcggttgatatgacatactttccaatattcctgataaagtttcactgtcacgttcatttgcttgacacccatatgtttgaatataatatttttttcctagtccaactttgaccatatctcctggaacatgataggcatcatcatagcgaccaacttcgtcacgacttcttcttttagcctcatttaatgaaggccctttaaaataattactataatctttcatttattcaccacttttctatcatattatatacataaatctctattatttccacaagaaaaaattcatttttattaaatctaattcttgcttttatcgtaaataaaaaaaataaggacttacgtccttattatccgaagaatccatctggttgaatagagaagtataaaactgctccatcaggtgtctttttaaaaagactcttacaatgtccagctgcttcatctggtgtaagttctgtttcacattcaatttcagccttgattccagtttttttaatgaatttacattttactttatcatcttcatatccatcaaaaaaatcgattaatttttgtgtttgtgcagtttgcattaataatttacattttgccataataaatctcctcctatatcacgcctactattataacgcaaaacactaaaaaaagaaacccttttcatctaaagtagggttactttttttgttaagtttttattacttaaaattatcgtaattctaacaataacctaagtgctgtgatttccttatcatcaacaattagatcatgaaatgaaggaatacagacaatttcatttccagttgggataatataaccccgagcaattgcaattgccttaattgcttgatttaaagcagcagctccaataacctgaatctgtaatttagattcatttctaatcatactagcaatagcgccagccacattattagggcatgacgttgatgatactttaattgtttccataattttcctcctaaaaaaatatatgaaaacatttaattattatacctaatatggatgatcttgattaattaagattcgttcaatcgctacaggtgtattttcctcaaaagtaattattactccagataactgaccactactttcagctacgataaatggcgctccaaaacctcttagccttgtgacgattgcatcaagatcgcaaccaattgcgctcatatacggccccgtcatccctacatcactgatgaaagctaatttactatcaattatcttttcatcagcagtctggacatgagtatgtgttccaagaacagcacttgccttatctttaacataatgtgcaaaagcgattttttcacttgttgcttcaccatgaaaatctatgatatgaatatcatgcggtaaatcaagatactcatcaattacttcaaatggatttgaagtacgactatccataaaagcaacacctaatacgctagttatcctaatcaatttaccttttacattaaatacccgtgatttaactccaggtagtacttttggctgattgattggtacaatcaatttatccgcttcatcaatatagtcatataattcctttttatcaaaagtatgatttcccattgtcatggcttgaattccctgaaatgataactcatcataatggcgttttagtaaaccttttccatgacttgtattttcaacatttgctattacaaaatcaatttgattatcttttacaatacgatgcaaataatcttcaatcatttcacgtccaattgaaccaaatacatcaccaataaataatattttcattttatttccctttcaaataaaaggataggctatgcctatccctatttagcaacttcacttgctcttacttcacgaattactgtaactttgatatgtcctggatatgtaagctcttcttcaatcttcgttttaatatcacgagcaattttatgagacatcaagtcatctactttatctggcttaacaacaattcgaacttcacgtcctgcttgaattgcaaaaacccgatcaactccatcaaagctttttgccatttcttcaagtttttctagtcgttgaatatagttctcaattgtctcactacgactacctgggcgtgctgcactcaaagtatcagcagcagcaaccaaaattgatattacacttgttgcaggtacatcaccatgatgtgattcaattgcatttacaactgtagcatgttcaccatgttttttagcaaattttgctcctaattccacatggctcccttccatttcgtggtcaactgccttaccaagatcatgtaataaaccagcccgtcgagctagttgttgatttaaacctaattcagcagccatgattcctgctaaatgagcaacttccaatgaatgttgtaaggcgttttggccataactagtacgatacttaagttttcctaacatcatgataatatctttatcaatttttgaaattcctaattcaaaaacggcatcttcacctgttttgcgaatcacttcatctaattcatttttagttttttgaactacttcttcgattctacctggttgaattcggccatcacgaatcaaagtctccaatgataatctagcaatttctcttctaacaggatcgaagcatgaaattgtaatagcttcaggagtatcatcaattattaaatctaccccagtacattgttcgattgcttttatattgcgaccttcacgtccaataattcttcccttcatttcttcacttggaagagcgacaacagaaactgttctttcaattgtttcttcttgagcataacgattaatcgcattagcgattatatcacgagaaagcagacttgcttttgatctagcttcctcctcttgatctttaatataagccgtcatctctgtagcagtttgttgttcaacctgcttaaataattcttgcttagcttcatttgctgacattgcagcaattttttctaattcaccaattttagcattgattttttcttttaattcagcttctagtttacctagtccggcttctctttcgtctaattgtactactttttgcgctaaaacatcttctttcccttgaacagcaatatcacgacgatcaactgtttgttcacgttgtaaaagtttattttcaagttcattaatttcttgtttttgttctttagcttctttttcagcttgaagttttaactcatatgcttctgtcttagcatctaaaattgcttctttaacaagattgtccgctttggcagttgcatcatctataatctttgcagcacttacgttagctttagagatttttaatttattaattaaataattaataaaaaaacctaaagccacagctagaacataggttaaaatagaaaaggcaatatttcctggcatatttgtcctccattttcttctatgtaaattatttttatgaatctataggaattcattatgtgacaagcacaataatattgtataatattttgacatcatttacaatgaaaagtgtttcgaggatatttttttgttaaagtcctataacaacaaattttaggtgattttaagataataatttttaaaaagagaaatatctatgattaaatcaacaaaaaaagatagcggtatcattttataatttagtttcatatcagtagtttattatgatagaatatttaagaaatgaggtaaaaaaatgtcaaaaacactagtattagcagaaaaaccatcagttggacgcgatattgcacgagttctacaatgcaataaaaatgttaatggtggtcttgaaggaaataaatatattgttacatgggctttaggtcacttagtaacattagctgaccctgaaaaatatgataaacattatcaaaagtgggatttaaatgatcttcccatcatgcctgaaaaaatgcaattagtagttattggtaaaactgctaaacaatataatgccgtcaaaaaccttatgaatcgtaatgacgttaaagatatcattatagcaaccgacgccggtcgtgagggagaactagtagctcgatggatcattaataaagcacatattaaaaagccaatgcagcgattatggatttcatcagtaactgataaagcaatcaaagaagggtttaaaaaattaaaaaatgctcgtgaatatgaagctttatatcatagcgcatatagtcgaagtattgctgactggatcgtcggaatcaatgctactcgagctcttacctgtaaatataacgctcaactagcttgtggtcgtgttcaaacccctacactagcaatgattgcagctcgtgaagaagaaattaaagattttgttcctcgcaattattatggtatagaaatcattagtagccaaattaactggacttggctatctgccaaaaaagaaaaacatttatttaatgaagccaaaatagatgaaactattaagaaacttcaaaatcaaaaattaaaaatagaaaaaatctcaactttcacaaaaaagaaatatgctccacaattatatgatttaactgaattacaacgtgatgccaataaactctatggtttttctgctaaagaaactttagcaacaatgcaagatttatacgagtatcataaagtattaacttatcctagaactgattcacgctatttaaccgatgatatcgttccaacattaaaagagcgtctagaagctagtcgcgggggggattatgacaatataattgataaaatattaaaaagtccaataagaaaacaaagtcattttgtcaacaatagtaaagttagcgatcatcatgcgattattcctactgaacagcctgctatgttaggttcatttacagatcgagaattaaaaatttacgaattagttttaaaaagatttttggcagttctattaccaccttatctatatgaacaaacaacaattaatgcaattgtaaatcaggaaatttttactgtttctggtaaaattgaaacccaaatcggctggaaagaagtctatggtcatgaagaagatagtgaagatcaaacattaccatcattaaagcaaaatcaatttttaccaatcactgaaataaccaaaacaactggtcaaacaaccccaccaggttattttaatgaagcaaccttattatcagcaatggaaaatccagttcgttatacaaaaaacacttcgaaacaattaagttctactttagtcaacacaggaggtttagggactgttgcaactcgagcagatattattgaaaaattatttaataccttcttaattgaaaaaagtggtaatgatattcatgttacaaacaaaggaaaacaattgttgaaattagttccacaagatcttaaagaacccgagttaacagcaaagtgggaaatggaattagctaaaattgctaaaaaagaacaaaaatcaaatatttttattaatgaaataaaaaaatatactcgttctttaatagatgaaataagttctagtgaagccaaattcaaacacgataatcttactactaaaaaatgtccagaatgcaatcatttcatgttagaagttaatggaaaaaaaggaaaaatgcttgtttgctctaaccccgattgtaaacatcgtgaatctgtttccatcatcacaaatgctcgctgtcctaattgtcataaaaaattagaacttgttggtaaaggtgacaaacagatgtttgtttgtaaaacatgtggttatcgccaacatatgaacgcctttaaaaaagaacgagaaaataaaaataagctggctcgtaaaagtgatgtgaaaaaatatatgaatcaacaaaaacaacagcagactgctgttgaagattcaccatttgctgctcttttaaaactcaaagatgaattaaaatagttcttatcgtattgataagaactatttttacatctaaatattattgacaaaaccataaaaagggtaaagccgtcaaacagctctagccctatcttttcttattcttgctcacttttattatcgctctctaaggagtctttgatcgcctgtgtaatttcttccataatttcactatgagtacttaagaaagtcttagcattttcacgcccttgacctattttttcacctttatacgcataccatgctccactcttttcaacaatgtctttttctactgccaaatcgagtacttcaccatcacgagaaattcctttaccataaataatatctacttgtgtagttttaaacggtggagcaactttatttttaacaactttaatattcactttatttccaacaatttctgttcctaatttaattgcttcactacgacgaatttcgacccgaacagaagaatagaattttaatgctcttcctcctgttgttgtttctggattaccaaacataatcccaatcttttctctcaattgattaataaaaataatcgtacattcagatttatttaattctgccgcaatttttcttaacgctttagacatcaaacgtgcttgaagtcccatttgcgaatcacccatttcaccatcaagttctacttgaggcactaatgccgcaaccgaatcgacaacaactaaatcaatcgcacctgaacgaaccaaagtttcagcaatttctagtccttgttctccagaatcaggctgtgaaagaattaattcatcaatattaactcccaaattttgcgcataaacaggatcaatagcatgttctgcatcaataaaagcagcacgtcctccttgtttttgacattcagcaatggcatgtaatgtcaatgttgttttaccactagattcaggtccgtaaatctcaataattcttcctttaggatatccgccgattcctaaagctaaatctaaagttaaagaaccagtaggaattacatcaacactaacggcagcgcgatcacctaatttcattacagaaccttttccgtattttttttcaatttgcttaattgcatcatccaaagcttggacttttttagcttcttctttattctctttagtctttgcttctgccataatattcatcctcctactattatatacctatataaatactaatttacttttattttttcattcaattttcgaattacaaaatcaattgcctgtttctggatttcttcacgagttccctttaaattcaattcatagatattgacaccttggtataaaatcccaatataaactaatcctactggcttcccttccattgcatcaggcccagcattgcctgtaaatgatacacagacatcactatcaagaatttgttttccattaacgcacatcaacgaagctacttctttacttacaactccatattttgaaattatttcatgcgaaattcctaatagtctttcctttgttgtactttgatatgttactaaacttcctttgtaaaccttagaaatgccaggaatacttcctagcattgcagcaaagttacctactgtaaaactctctacactagatatacttatattatattgtattaatgttttagctaattcatccatcacattgtctccgtaagcatctcgcgattttttaagaaataatcaatcccgctaataactgaaattactgtagctagccatgctaaagcgttagctacatcgactcccagtacagtaaaaggaaaattattaactaataaaaatcctaatgcaatcatttggctgactgtctttagtttaccaagtttacttgccgccacgactacttgtttactcgcagctgacattttaatcgcatcaactatagtatcccgagaaatcattataatagggataataatattgattgtctggtcacttgccaataataagaaaatcgtattaattaacagcttatcagcaattggatcagcaaatttaccaaatgttgttattaacttttcttttcgagctatttttccatcaaaataatcagtaattgatgcgataataaagataaataaaatgataatatttactaatgatatatttgtctccaaaacatgatagacaggaaccgtaattcctgcactatcatacggaaacatataaataagaattaagaagggaactaacaatacccttgtaactgttaatttattcggtagattcattattgcacccgcgtaattttaagggtatgattacccccatcatattcacttgcatcaatttctagaggttgatcgttaatgtagaaacgatgtcccataaaatatcctaattttaattccaaattttggaaattctctaccggaatatctagttcaactatttctggagctgcatcagttgcatttgatttattagcattattgtaaataccgctcttgaagccgctataatcactaccattgacatttaattgtgaccatgtccgaccaacaaattccattttaaacttgaaagtagtcatacttggatcaagtttaatactataatctaactcaccatttttagttatttcaactgtaggcgtttcagccttcttatcatcttcatttttatcatcagtattagaatttttgttgtcatcactgtcttgtttaccagcatcattatttccttcgacagttggtgtattgttatctttaaaatctggcgcttcagtattagaacgccctgcaacgattgcataccaaacaacaaaaatgatggccacacaaaccacaccaactaaagcatatttaaaatatctaagcaaatagcgatcttcataaacacgtttattagagatagattttttaggttttacattttttaaatctttaaatgtatcacttaccttaccagaaatagtaatgttctttttattttcttcaactaaccgtttatttaaatcctcttgacgaatttcttctaactgaatttcttgtgtcagtgcttcaaattcagcatctaattctttttcttctaaccctaggtatttagcaattttccgtaaatacattttcaaatataattcgtcacctttatatttgtcaaacttacctgattctatatcttttaagacagctactgaaataaatgttcctttggccaactcttcaatcgtgacccctctagcctcacgttctcgtctaacatgttcactaatattttccatgagctatcctccttttttccataattataaaaaagcctataataaacacataaattatatcataattattatttatgacaataacctaatcacatttattttatgaaagattttaaaaaaatataccttaaaaaaaccaccttatatatgatactttataaatataaactatttataaactaattgaaattaattgagtaatttttttaatccatttattagtctacaagttgacaatataaacggtcaagtaatttttaacaaacacattaaatcacaaaatcaaaaaaaggctatggattgatgtgacccccaaaagttagctcaaaaatctaactatcagaatactggtacaaaacttacagcctttttctaatacttattataataaagattgatataattctttaatttcagcaacgctagtttctcgtggattaccagggcggcaagcgtcatcatatgctgattgtgataaaaagtcaagatcttcaactttaacaatttcttttaaatcagctggaattcccacatcttgagataattttttaaccgcatcaacagcagctttacgatatgcttcttgatccattcctgtagtatcaacacccattgcctcagcaatatctttatacttagtccctgttgcaggagcattatattccattactgttggtaaaataatcgcgttagccactccatgaggtgtatcgtataaagcacctaatgggtgagccattgagtgaactattcctaaaccaacatttgaaaatcccattccagcaatgtattgtcctaatgccataccttcacgaccctcaggagtattttcaacagcacctcttaatgaacgagcaataatttcaatcgctttaatgtggaacatatcactcatttcccatgctcctgcggtaatataaccttcgatagcatgagttaaagcatccattcctgtagcagcagtcaatcctttcggcatacttgccatcatgtctggatcaacaaatgcaacaactggtaaatcatgaggatcaacacaaaccatctttcgatctttttgtgcatcagtaattacataattgattgtaacttcagctgcagtcccagcggttgtgggaacagccaaaataggtgtacaaggatttttagtttcagctacaccttcaagacttcttacatcactgaattccggatttttatcaatgattccaatcgctttagcagtatccattgaagaacctccaccaatagcgatcatataatccgctttggcttcctgtaaagcttttacaccgctttgaacattttcaatagttggatttggtttaatatcagaataaactacatagtctaaatttgctgcatctaataagtctgtgacttttttagtaactccaaatttaattaaatccggatctgagcataccattgcttttttaaagccacgagcctttacctcagttacgatttccctgatagcaccacttccatgataacttgtttcatttaaaataaatctgtttgccatattaaaatctccttttgttttatttcttgataaaattttaacatggatttttcaatatattcaagttacagatgtaagcgtttgtaacattttcgtgattgtcatgcaatttagttgcagtaataaaaaagtatgtttccctacttttttatatttaaaataaacggctctaaccgttgcggtaatgcttcaatcaataattttacaatatcatctatactaatcggcatatcacccaatacccattcaacggtcatatcaatcgatcctttgcaatacatctttaacaaaaaatcaatatcagcagtaactgattgccccaaattcttctcaatgatgtttttataaaactcatatatacaattaaaatcataattaaccagattattataatcattagatttaaatgcttctttaaaaaaggaatgttcgcttttaataaaagcaaactttaattgtaaagcctcttgtaaagaacacccatcgcccatttgacgaaatgactttaaaaccagcttttcgaagtaccagttaaccaagtcatatttatctttaaagtagcgataaaatgtctgacgcgtcatcccgctgcgtgtaacaatatcagttactgcaattttatccaagggatgaaccttaattaaacctttaattgcttgagcaaatacatatcttgttttatcatgtttattcatattcatacctctttaataattataaacgaggataaaaaaatagacaaataaaaaagctgaaaatattcagctaaataacgactcgttttgtaagccaagttctgtttttcaaacgattatttatctatgcacatgcatccgccttcgcgttcatttccgtttagacgattcccctaccaaatttgggtttcttccttgcagagtttacctcttttcagctaatctttcgattagaatagtctctgtggcactttacggcttatcaaccatacttacgcttaggtcttaggcccgtcgttagctcacgctactgtgacttattgattcgtcacatacaaacactacaagcatcgcagcttgtggaagcctggactttcctctacttttgtagcaatcgttttctacgagtctattatattttacttatttctaaatagaaaacaagtattatttttcaaacagtcgtgataaaacaaatttatcaattacttttgcaatagccttccttattagatgctttagttatataatcatattccactttaatccttgctacactattttcaacttcatttctttcactttatcaacaccacgatgattaaattcaatataacgattttacctaaattacttacaccaagatttttatcaaaaatctctgttacttccatcctatcagctattcgattcaatatcatcttgctaaaagttgcaaattaatcagaactattattctaatagttactcaaagcgctttattcagcgatttccaaacttccagttcctatccaaatattttccatccctaccatgcaatcgcacctcaagaatgttgtatacacctaaaataaaaaaattgttattttttaaattgacgttattgacaattctttttttatgaataatatatagttaataaagttaactaagaggtggaattatgaaagaaccagaatggataaaaatgataaattactcacaagaaattcgtttgttttcgcatttattaaatcgccgaggtaagccaaaaaatgttcttactaaagacgaactagatttattatcaatactaattatcgatgatgaaataattacccctattattatcagcaaacgaatgggtgtatcaaaaccattagtaagccgtcttattgagcaattaaataaaaaagaactgttacttaaaagtccacacccatttgataaacgtagttattgtttaaaaataactgcacaaggaagaaaacatcttgatgatatatatacttattatttagaacccatctatcaattaaaaaagaaattaccatctgatgattttacacaattaatcaacttaataaaaaaatctaatataaccttaaaaggaggacaataatgactatttatcaagcaatgcaattaaatgttaaaaacttaaaagctgcaattagtgatgcacctacaaaaaaagataaacatcgttatattgcagcaatgatcctaagaaatattttctgcttagccttttgtattatctttatcactttttttacaacactttttggaaatgaaaatagttcagtaggaataatcggtctgttggcagtattatctcttcgctttactgatttagattttaatattaaacaaagtacattagccctaattgccagttttgtaatatgtgctattgctccgcatttagccaatatagtcccattgggctttgggttattaataaattttagcgctttactactaatcttaatacttacaagtcatcaagttagttacgctaaccattttacctttattcttggttatattctcttatggggaaacgatgtcagcgaaaacagttatactctgcggattattgccatgatggttgcagccatctttacagcacttgtctattatcattgtcactatcaacaaacgatgagacttaacttcaaagacattcttaaagatttttttagtcctagcaagcgaacattttggtatctaaaaatcagcagtgcgattgccttggttatttttcttggagaaatgcttaatttttcaagaactatgtggattgcatttgcatgtatgtcaataatcaacatcgatcatgaacaaattatctataaatttaaacatcgtgctctttttgttgttgttggcagtataatttttgggatactatttacaatagttcctaaagaatatttagggttagcagggattttaggaggaatcatggtaggttttagcggcagttatcattggcagaccgttttcaactgttttggcgccttagcaatcaccattgatttatttggatttttaaatgcaatcatcattagaatcgttgccaatatcgccggtagtattttcagctttgtttatcaccacctttttgaaaagattattcaattattaataaatgagaatctaatgtttgataataatttataatagaatatctaattaaaagtgctcttagagtttaaacaactaaactttaagagtatttttataacaaaaaaagaggctttcctctaattttcctttagaagtcacccccagatatatttttatcctatcaataccttattaataatcagtccaattgccccactgacaataaaaatcaaaccgaccccaaccttcttttttcgtgaattcattacttctctatcttgatttgataatgtcgatggatatttatggcgaccaattaaatacaaaatcagcccgctagaattttgtcctccaatcgctataaatcctaaaaatttagggtgttttaaccctcgacttcgagcatcaagctctgctatcttaaaaacttgataagctgtatttacggctccaggcaaaacaataaaaactaatattatctcataccatttcattttcttttctcctaaaatttttttattacctgataaaataaagcagcaatactacacatagcaatcaccaggacacttgccagtaaatatttattatttgaaattatagtattaaaaataactaaaccaaaaaataaaataatattaattatagcaacacaaattaattttttattactactaacaatattggtactttcattcaaatgttcaatcatcttatcatcacctttcaacagttcatccaaactaatttgatatagatcacttaatttaataatactaataatatctggataagttttagcattttcccaatttgaaattgtctgtcttgatacttgcaactcatcagctacatgctcttgagttagctcaacttttatacgagctgttttaattttctttgcaatttccattaatccttcctcctgattgcatcatcacatttatccccttaattgtctatcaaaaacttttgacatcgatatttttactgtcaaaacccttttacatcataataaaagacactttattgcttataaagtgtcttattaacaattatctattctgattaaatacgactttttctaataacgataatctttttaaaatatcaacgtttgtagaaagattttcttccatcgcatggatattatcatcttgaagagccttttctctttcaagtttagcaatcttgatcttttgttcgcttaaacgcgcttccagttgatcaatcttatcatacgaagcatttaacatagctgcaaaagcttcataatcatttacaaccatatctaaaaaatgatctacttcttcagcattatatcctttaaaatctactttgaattctttagctattatctttttagggcttaacattactttcttttccaagtttatcaactccttatctctactttatattgaaacaaaaaattgtcttaaatgcaagcgattaatcgattattaacataatgttagtgattttacttaaattgacaatgttttggaaactcataagatactatgatattttaagacagatatggtataataccttcgtaaagtaataaaaaggagcaagcatggttaattatccaaatatgaaaaaaacaactgttcatcaaacaaagctaattgatggaaagttaaatactcgtcatcggggaatgaatttagaagaagatttaaatttgactaataaatattatttagctagaaaaatcgcaaatattcataaaaaacctaccccgattcagattgttaaagtagattatcctaaaaggtctgcagctagaattgttgaagcatattttaagactccttcaaccaccgactataatgggatatataaaggtaaatatctggattttgaagcaaaagaaactaaaaaacagaattttccttttacgaatattagtgttcatcaaatcgaacatttaaaaagcgtgattgaacaccagggaattgcttttgtaattattgcttttacccatctaaatgaggtatacttagttaatgcatcatatgtaattgatgcatactatcaacctgatcaaaaatctatctcttatcaaacggttaaagaaaagggacatttaattgaacagggatttaatccccgcttagattatttaaagataattgatcagtattatttaggaggtcacgaaaatgacagatagccctacaagaaaaagaaaaacaaagaaaaaattaaattggaaaaaagtcgctacatctctagtagttgtaattttaatagtctgtttaggcatgggttgcttctttgcctggtcagtatacaaagaaaccgatgatttctcagctaaaaaattactttctggggaagcgagtaagatgtatgatattaatggtgaattaatgtatacatttggtagtgacacaaatggtaaacgtgaaaacgttacttatgaagatttaccacaagtattgattgatgccgttgttgccgcagaggattctcgtttctttgaacataacggttttgatttaccacgtattgctaaaacaatgatcactaacttagctcatttaagtattcgtgggggaggatcaacaattactcaacaggtaattaaaaaatcttactttccaaaagaagaacaaacttatacgcgtaaactaagtgaaatcattcttgcaattcaggcaactaaagaaattagtaaagaagaaataattactttatatttaaataaaatttattttggccgcagcactagctcaatcggaattgctgcagctagtaaatactattttaacaaagatgtctcacaacttacgcttccagaagccgctctattagcaggaacattgaattcgccaagtgcatatgatccatattataatttagaaaaagcgactcaacgtcgagcaacagttttaaatttaatggttgatcatgggtacatcactcaggaagaatgtgatttagcaaaacaagtaaaagtcgaaaatactttatcacaaggtattacttcttctgacgatgctttagctgcttatgtagatatcgtcactaaagaagttaaagaaaaaactggcttggaccctgcagaaactcaaatgaatatctatacatattgcaatcaagaagtacaaaaaatggctacagcaatggctaatggtgaaacttataaatatagcgatgaagatatgcaaatgggtggtagtgttcaatctactcaagatggtcggatcatcgccgttatcggtggacataactacaaatccggtgatttaaataaagctaccgtaaaacaacagcctggttcatcaatgaaaccactattagattatggtcttgcctacaaatatctaaattggagtactgttaatactgttaaagacgagccattgactctaggcggtaaaacaattaaaaactgggatggtcagtaccatggttcaatgagtatttctgatgccctgcttaattcatggaatatcccagccattacaactttccaagaagtaaaaaaagcagctggcagcgatgcgattattaaagacatggaatctgttggtatcgatatgtctgaccaagataaagaattaagtgatacttatgcaatcggtggctggaaaaccggtgtaagtccagttgaattagctggtgcatatgcaacgattgcaaataatggtaattatatcgaatctcatacaatcaactatgttgaagttgtcgaaacaaataaaaccgtcaaaattgatgaagaattgcaaaaaaatgttactcaaagcattggtgaagacgtatctttcatgattcgtgaaacaatgttaagctattcaagcagtactacaggaagttattcatcactaagcggacttgataacgttggcgctaagacaggaacgtctaactgggacagtactagtccatatgttaaagcaggcaagagccgagatttatggatgactgcttacacccctgactatacatgttcagtatggatgggatttgatacaacaggtatcaaaaaaggtaagaatacttctgactataaagcttatccagctaaagtagtcgctgaattactaaaatacttacaaaaaaatacaaccgacaaaaaatcatatcctgagcaaccatctggtgttgaacaaattcaagttgttgcgggaacatatgatagtccgactgctaatacacctgctagtcaaatcttaacaggatgggctaaaacaggatatggtccaactacagcagctaaagaccctgaaattaatactttatcagcattcgaggcttctattaatggtaatggtaaaatagatgttagctttaccgcctatgaacctgcaaatcctgacattgtctatgttgttgaaatctatgatgaatcaaataatcttttatatagtactaaattgactacaaatagtggtacgattgattatgccccaaccggtaaagtaaaggttgttggatattatgcatattcaagcggtagtccaacatctaataaaatcgaaaaaacaattggttcaagtgctaaattagataaagtaaattattcaattacttccggtggttcttctattactaatggttcgaccacagcaaccagttcagttgcaattaaagtaaacgctcaaagcagtagtaatacgattacgattcaatttatgaattcttcaggaggaacaattggttcacctagtacctttacaggtagtgcaactaaagaattcgcattaacaccaggtgctcaatataccgttaaaatcactgaaagtgatggtactaatacagttagtgcttcaatcagttttactgttggtggtaattcaaaccctggagaataataataaaaatatcagcttttaataaagctgatatttttattaaaaagacatcctcaggcgcctataagtatttatttttaatcggatccttacacatatcaaccagtttacattctgtacaactagggttagttgctttacaaaagtatcttccaaagaaaataaattgatgatgggatttattccatctatttcttggtatagaacgacatagtttcttttcaacagttaaaacattgtcatctcttttagcaaagcctaatcgtttagaaatcctttcaacatgcgtatcaactgcaaaggctggtatatcaaatgctacagaacgcacaacatttgctgttttacgacctacccccggtagactctctaattgtttttgatcacttggtacaataccatcaaactgctcaattaaaacatgtgataatgctagtaagtttttagctttgtttcgataaagtccaatggttttaatatcctgctctaattccggtaaactagcttgacttactgcttcaacagtcggatattttttgaataaattttctgtcaactgattaacttttttatctgttgtttgtgctgataacattactgcaaccaataattgaaaatcactttcatgattaagttcacaataagcatctggaaacaattcatcaaaatattctaatactcggttagttttttctttattcattttcccaccatttatattcactaattggaacttttcgctgtggttgttcactttcaacatagcgttgtttaataccatttttagcccaattattcaatatcccttctacatatctaaaattaagaacttggctcttcactgcctcttttaaggctttaacaatcatttcatcactataatcgctttctttccaatctttaataatatttaattcaattggtgataaaggtcgtccaaattgttcttcaaaaatagtaacaatattaagactctcctcctcttgtttagcactcgctgattcatgatcttgtaatagtttatcttcaagatgattcaaactaattgaaccagctcggttataaataagttttttatttaataaactttgtagcaccttattaagatcatgacttgtcaacatcgaataattttgaatcatctgtggcgttactgtcttgatccctgcttccattaaagtataaataagcagcaaaatatgacattcattaccgtcaatctttaattcctttgcgcttaacaccagtagtcgttcaatattaatgcatttactttcaactaaactctttaacatcattctatccattatcaattcgatatgcctttacgaattccccattatcaattccataaaaagcataaaccagtgaatcctttccttgatacattaaacaatagacaaagatttcattttcataaccaactgaaacttcacttggctcctgtttatatttttctttaaatgcgttaatacatacttgttgatccactacatcaccactataagatttaattaatttatatttttcatcaaaaactgcatattgttgttttttgcccttggttgcacgaataatatagtaacttttatcactattatagcggtcaaaatacttaacattactataattattctctttaacaataacattttcaatacttgtaatctcatttttatgttttgaatagggaacatgaacccaaagcatataaaaactaacaactattaaaactaaaactaaaaaaacaattaatatattaaaacgattttttcgtaaaaatttcaaaataacaccaactttcctcgcttaattattatactatcaattatcataatataaaagaaaaaatctctaaaagagatttttaatcacgatcattacctataacgatcaatacaattcttaataatgacagtaccgtcgacaacatcgctgccacataagtaaacgccgctgctgataacattgatttagccccactatattcatcggtagtgagatagttagcttttaagattcttaatgctcttgaagaagcatcaaattctactggcaaagtaacaatttgaaataacaagattcctcccattaaaaatactccgatccaagcaacacttgtatttcccatgatcaaaccaataaatacagcaatccatcccaaatattgtccaacattgcataatggcaagatagcatttctaaatacgagcggcttataaccaactaaatgctggattgcatgcccacattcatgactagctaccgcaagtgccgcaatcgatgttccatcatgaatttcacgtgacaaattgattgtcttatttcgagggttgtaatgatcagataattttccattaacaacatgaatttgaatatcactcaatccatttcgatctaaaatttctcgtgcaaccatcgctccggttatacctcggctattggggattctttcatagcgtttatatgcactattaacttttatttgaccatatatcataattaatgatccaataataactaataaatacccaaacatataatagctattcattggaaaataataaaatggcatatatatcaactcctttacactctattatacactatattattaacttattattaataaaataaaaatgcaatgattaattcattgcatctttcaaacgattactaggtttgaatgtaactgtcttgcttgcaggaatgaccatttcttcttgagtttttggtgaaattcctttgcgagctttacgatcatttactttaaatgttccaaatccagagattaaaactttatctccttcaacaacactacgcgtaattgtattaaaaactgtgtctactaaaatttcggcatcttttttagttaagtttctttctttagatactgtttcgactaactctttcttgttcataacaacctccataattctaatacttcgaaagtataacattaaaaagtaccgatttcaagcacttttatagcacaattgcaattacattacttttgcccttattaacaatttttgacaaaatatcatgcagtcttaaactggcattttcagggattgcatttagcttaatatacataccttcttcaatcaaatcaccaagtttacgaccaaatacatcacaatcaaaaatcgcttgtttatcatttccactagaattcaaatattcaataaatgcttctgcttgttccctcgatccaataattggttcaaaagtactttcaatatcaactttgatcatataagtagttcctgctttagaaacaagtttcatcccataacgaggtccttgtttaataatttctggatcactcaactcaatttcatctaactttggaattgcataaccatatcctgtctgctttaccattctaatagcatttgaaaaaccttcatattctttttttatatctactagttcttgaataaaggttaagaaagttgcctgatcaaatcctttatcgccaattatttcttctaatatttcattatatagcccttcacgttcttcaatttttaaagtagcacttgaagtagttgtatctattcctgttaagtaagctttatcaacaaaatcatattcgctgatcgtatcaccaatccgctctacatctttaaactttttaattgattgtaatgattcttttaatgatgtatctaatgtttgttttaaccaatgactatttgacatcattgctaaccatttaggtacctcgatacgtacttcactgattttaaattcatataatgcatcttttaataatgaaacaatttgtggttcttccatatttgtaacatccatagatagaactggaacatcatatttagcggttaaacgttcatactcttttttacaagcagaactgttgacatctttagtattaattataataataaacggcttatcaatgtctaatagttcttcaacaatactatcagtcgcttcattataattagctcctggaatatcacaaatactaccatcactagttataacgattccaattgttgaatgatcttgtataacttttttcgttccgactttggctgcttgatcaaatggaattgattctaaataccaaggcgttttaacatagcgtattccttgatcatcttgatatccctttgctccttcaataacataaccaacacaatcaactagtcggacattaactttaaaattctcatccattaacatttctactgcttgattaggaataaatttaggttctacagtcataatcattttacctttaccagactgtggcaattcgtcaatggcacgcagttttgcatctttatcttcgatatatggaatgaccgccatttccataaaacgtttgataaatgaagatttcccacttcgaaccggtccaaccacccctaaatatatgtccccatcgcacctttttgcgatatcatgtaagatatttttcgtttccattgtaaactcctctcttcgtattatttatatgaaatatgcctatatttagaacacatctaattattaatttggtataattgataaaggaggtatttccatgtactcatatttagaattagagaataaatcttttgaagatttttacttgaaattttgcgggatgcaagaatgtaaacctaattattcatatggtccagctgttcgtccaaattatctattacattactgtctctccggtcaaggtgaatatcacgttaacaaccaagtatatcagattaaagcaggtgatgcttttttaataatgccaaacgttgtcacttattatcaagccgatcaacatgaaccttggacatatttatggatcagctttgatggttctaaaactcgtcaatatttaaaacgatgtaatttagatgaacataatcttgtagttcattgtgattatatcaatgaattgagagaaacaacgattgctattcttgcacacaataaactaagctatagtaacgagttatttattcaaggacaactgtataccttttttagttttttagccaaaagtgctaatattacttataatgataatgtagcccctaactacaatccatatgttgataaagcaattgaatatattcaaaataattaccaggaaatggtaacagtcaacgagattgctgattacctttctctcaaccgcagttatctaacaacattatttaaaaagcatcttcatttatcaccacaagaatttttattaaagtatcgaatgatgcgcgccgaagatcttcttactaatactgatcttacaattaatcaaattgccttctcttgcggatattctaaccaattatctttttcaaaagcatttagtaattcacatcaaatggcaccacgtgattatcgtaaacaatttaaattagttgataattcaagaatgaatgatcctcataaacgcaaagaatagattattagatcaatctattctttttattaattattattgcttttattcatgtaagtaattgcaattataatatattaataatgattactattacctatttaaaagaattagaaaagttaagtagtatttgcgaatttgtttatactagatctttccacctgaattttgtccaatttacaaaatgacaagtttaaaattgttagaagccaataatgtgaaaacgagagcaaaaggaaatattcaccgatacactaaagattaccttcatttatacgtttgtcctaccagagcaagtgatacacaagatgatcaaattaaggcttcaaaatgtattaacgcacacctgtgattaaatgccatttctatggtcccttatgactatccaccacgaaataaagaagttaaaatgcttaatgagttaggttatttaacctgaagtaaagcaaaacaagaagtaatagctcaaaatctttcaaaacaaacaagcaatcctgttattaagcaaatagctaacactctagtcaaatctaaccgattaataaatgaagacattgctcgtaaatcaagatttatgctacctcaaagtttatatacttgaaactttttaaacaagttattgaaaaatgctaaaaatgacgtgagaaagatttaattaataaactactaaaaaattccttgtaatgaaaaaagctaatttaaacatatatcaaataaagattcataaattaataaaatataaattgctttttaatttaataagcgttataattaaatagtaatgattactatttaataaatttggaggaaaagaagatgaaatacgtttgtaaaatttgtggatttatttatgatgaagctactcaagatgctaagtggaatgatttagatactgattgggtatgtccggtttgtaaagctccaaaagaaaaatttgaagcagtagcagaaactagtactagtaaatatgcgggaacaaaaactgaaaagaatttaatggaagcctttgctggtgaatcaatggctcgtaataaatatactttctttgctgaagcagctcgtaaagaaggattagagcaaattgctgcaatttttgaagaaacagctgatcaagaaaaacaacatgctaaaatgtggtttgccgcatttcatggaattggaacaactgatgaaaatctagaagcagccgctgcaggtgaaaatgaagagtggactgaaatgtatgcaagaatggcccaagaagcacgtgaagaaggttttgaagaattagcaattaaatttgaaaatgttgctatcgttgaaaaatcccatgagaaacgttatctaaaattattagaatcatataaaaacggcacaacattcaaaggcgatgccccaaaaggatggaaatgtcgtcaatgcggattcatttatgaaggagatgaagcacctgaacattgtcctacatgcggatatcctaaagccttttttgaaagaatgtgtgaaaattactaataagaattaatataactattttaaaaagatgtaattaaatataataattaaatatttggattgattactttataaagaaatcaatccttttaatttatgactttttgattataatattctaaatccatacctataaactattttaaatctgattaaaaacttctcatctaaacagttctctttgatatataaataccccacaagctagaataacggtttaccgtagaatagctctacacttaagcctgtcttatccaactggtgaggtttactcaggattattatatttttgcttttaatacgtagattctagataaataatctccattagtcccatcgtatttttctttattttcaccgcaagaactatcagttgtaattaaacccaagttcattaattcatcaccataatgaactgtattattaagattaacatgatattctttatccggatctaatcccaacagctttacacgacggtaaccaacattaacttcctgcaaagtacgataatatccaataatagcagtattctgatcctgtgatacaaccatccaaacagtctcattaccttcaaatggactttttaaacggtaaaacgttccaaactgaataatctcccgatagtccttcataaaggtgatttcttctttaacttttatctgttcatccatgcttaatttattaagatctaattcgtatccaaaagtaccaaaataagcaacatttgcccttgtttcaatcggtgtatttctcaacaactgatgatttggcgctgccgatacatgagctccaagactcgaaacaggatataccattgatgttccatattggattttcaaacgttctagcgcatcagtatcatcactggtccaacattgtggtgcataatacatcattcctggatcaaaacgagcaccaccactagcacaagattcaaataaaatttcaggaaaacgacttgttaacaattcatataactgatacactcctaaaatatattcatgcataactcgtccctgactctcactatcgtgacaactagagtaaacttctgtcatacagcggttcatatcccatttaatataagaaatatttgctttatcaattacttctgtcatcatattataaacataaataacgacttctggatttgaaaaatctaatacaaattgattacgtccatgactactaggacggtttggtgtttctaaaatccactgtggatgattacgatataaatcagaatttttattgaccatttctggttcaaaccacaaaccaaacttcattcccagattatttatttttcttgataaaccactaattccacttggtaatttttgtaaattcggataccagtcacctaaccctgcaacatcattattacgtttaccaaaccagccatcatcaagaacaaataactcgattcctaatttttgagcagttccagcaatatccataattttttcttcatcaaaatcaaagtacgttgcctcccaattattaactaaaataggtcgtacttgatcacgatatttcccacgagccaatcgtctttgataaagtttgtggtaagtttgtgacattttatttagtccatcatttgaatacaccatgactacttccggagtttgaaaactttctcctttttcaagactccagctaaaacagtggggatgtattcccatcatcactcttgtaacatcataagtatcaacttcaacctgagctaaaaaattcccactatatacaaaactaaatcctaaaacctcaccagcatattcattacaattttcacgctttaaagcgatgaaaggattaaaattattacttgaacatcctcttagagaatatatagattgaattccatgctctagctttctctccttaatgctcctttcacgagcccaagcacctgttaattcaatcatctcatattctttgtcgggtaaatcaagtgacatactcatcacttgctctaaagttattttttgttcaccgcaattttcaatgtaagcatttcttgtaattaccggcatattttcaaaaattgtgtaacttaaaataatttttgaatcaattatattatcatataaagttattaataaagttgttgcttcatctggtgattcaacatatgtcgcgggtaatttatctaatttaggcttaccacttataatagtatgcccctgatagttaaacgaaatgattcgactaccatttgcttgagcgatttcaatcgcagggtgacgcatatcaccagagccataagcaggatattcctgtttaatatgttctaaagaaaatgttaaatcgccttcaaaagcacatgatgccattggtcgctgcatagtttcaaataaatgatcaaaattttcacgatctttgattgctttaccataataaagttgtcctaattgattattttttaaaattttaaaaatataacttatctcttgattatataaatgaaatatcttagttgttttatgaaatttaattggcatatttcttctcctttaaatcaataatcggttcatttgaattttttatatcttccgttacatcatcaagaatcatctgattttcttctttccttaaagcgattatattcataattctttgatagtacgctccgtttaatttgtaatactttttataaataatataacttattagcactaaaataattggtaatgcaaccataataatacgcattccattttgagttgccatagtttgagaagctccagcaacatatcctgtggcatctaaagcaaaacctgtaaataaagcacccatagctgaagcaaattttactaataaggtttgaattgaaaaaattacagactcattacgtgtccctagcttatattctccataatctacaacatcggctaatactactgtcactgtacctaattgtaatccagaaccgaatttgacacaaatccctgctactgctgttaaaatataattttgcggagcaataaatcctgttactaataaaatgattagaccaactactggtattccactagctaaagcatacacctgttgtttacttaatctttgagataactttggaaagatgatcaaaccaaaaatctctgcaaatcctgcaaacattgtaaaaacagaaaataatcccttattgcctgcaacataaataaaataataagtttgaaccccagcaatacaattcattccaaaattaaatgttaaaatcgttgctattgctactaacagctgatcatttttacgaattatttcgaacatctttctaaacgaagtcttttctggtttctttgtttctactcgatcagctgatttaacattaactacagtaattcccacagttacaataaaaataatggcaatgacaatagcaaaatttgtatatcccacttgagcatcaccatttccaaggaaatccatgatttgtaatccaaacccaccaactaacagagaacccccaatcgatgcaaaaattcttggaataacagctacacgatctcgttcttctggatttgatgttaaattaggtaacattgaccaatatgggatatccatgacggtatatgtcattccccatacgatatacataatagcagcaaatatatacaaactagttcctgataatccccaatcagtaaataaagcaactaaaataattgcattaacaatagttccaattgctaaccaaggtctaaatttaccccatctactatgggtgttatcaacaatcattcccatacctaaatcattcccatacctaaatcattaacagcatcccaaaattttgctaagaaaaacaatgttcctacaaatgaagctgataatttaagaacatctgtaaaatacaacatacaataagtaaagataattccacagcacatatccttaccaattgcgcctaccccatatgaatatttttccttaaatgataatctatcattattcatttttctatcccctttcaacgataataaatggttcatttaaattaaccataccatatctattaacagttatatttttacgatttaaatttgtaaaaacaaacggtgttgcatcaatacaacgatgtttttttaatatttctgaatcaaaagttaacaaaatatcaccctgtttaacaacttgatcaggatctacaaatattttaaagccatccccgtttagttgattcgtgtccaaacccacatgaattagaaaatctattccttgacctttcaaaacaattgcatgctttgaagaaaaaataaaatttattttaccatcaattagtgcgacaactctattaccagttggaaatattacaaccccttctccagtcattccttttgaaaaaacttcatcaggacaatactctaaaggataaacttttccttctatcggacaattaacttgaatttcctttttaaatactcccatcactttcctcctcagtttactgtaagcgcttctatatcgacaattataacatttggatatatttataatagtattagatgtattttaaatatgtcaatttgttatatattccctaattacaaaaggaaagtaattgaaataaatttatttattaatattatatattttcaaaatacaacattaagacatatttttataacattttaactaaaattataaagtagcttttttatttttttacctttaactttaagattcattgtattagaataaaccacgaggtgaattattaaatggaattttcaaaacgaatggaactttttcaagaaagtatttttacaattttagcaaaaaaggcagcattaagacgtgaaaatggaaaagaagtaattgattttagtacgggtacgccaaatattccccctaccaaaagaataagagaagtgcttgctaatgctgccctagatcctaaaaactatgtttatgcgattaatgatttaccagaattaatcaaggctgtaatcgcttggtataaaaaacgttatgaggtcattttagaagatgatgaaatttgttcattactgggttctcaggaaggcttagcacatctagcaatgacattgatcaacgatagtgacattgtcttagttcctaatcctagctatcctatttttaaagacgggccgttgcttgctaatgcaaatattgtcgatatgcctttaaaagaagaaaataattatttgattgactttgataaaattgatccaaccattgctaaaaaagcaaaatttatgattgtttcatatcctaacaaccctacctgtgcgattgcaaatgataagttttatttaagattaattgactttgctaaaaagtatcaaattattgtattacacgataatgcttatagcgaactattatttgaaggcttaggtagaagctttttatcatatcctggcgctaaagatgtaggtattgaatttaattccttatcaaaaacttatgggcttgctggtgctcgaattggatttgcagttggcaacaaagcaattattgaacagcttaaaacattaaaatctaatatggattatggcatgtttatccctattcaattagcagcaatcgaagccattaccggtgaacaaaattgtgttataaaaacaagagaggcttatcagcggcgtcgcgatatctttttaaaatgtgctcaagaaattggctggaatattaaagagacaaagggaactatgtttatttgggcaaaaattcccagcttatatcaaaagtcaattgattttgttaatgatttatttgagcaaaccggtattttatttattcctggtagtgcttttggcagcgaaggagaaggatatattagaattgctttaattcaagatgaagaaataataaaaaaggctttcattaaaatgaaagcaactaatattttcaaaaattaaattttaaatatcaattagcaaacctctttttggttagaatcaaaaagaggttttattgctcaaactacttttatcattatttatagatataatagaaaagcaaacccgtttgggccttgcttcattatgttaatttttcttacatgtatgtaaatgttgataaaaagcgcctaatagattagcatcattacgatattgacaaggaacaactacagggcgtgcaattggtgaattagcctttaatccagtttgatacatttcttctatatgtttctcaactaattctaataataatggttgtgctgagataccaccaccaatcgcaattttttctgggtcgaaaagtgcttgtaaattataaatttgaacagctaaacgattacagaatttatcaagcccagcaagtacctttttatctccactatttgccatttcaaaaatctctttaccattatattgttcttttgttccaacagactcttgaactgcctttaataagccaggaattccattcgtagctgcccatacacattcagggttattgccatcttccccattagtccgcatccatgaaaattctcctgaagagaaatgtttaccaatatgaactttaccatcacgaacaatacaaccgcctattccagttcctaaaattattacagcagcatcatcaacatcttttaaacatccaaatcctacttccgcattagccgcacatttagcatcattaccaatcgtaataggcaacgggcaacgttcttgtaaaatttttacaatttccatatcttttatatatttatatgcaccaccagtataagcaaagcccttttgaggatctattgcacccggcatagaaattgccataccaacaatttgttcagcatacttatcatacagttctccaattacctcaacaaactgctcaatactttgatgaggtgcaattgtacttcctttttcaataaactctcccgtttcatttaataaagcatacttgattgaactaccaccaatatctaatgttaaataattcatattatctcctttcatatttcgctcttacttttaagtataacgatatttccaacaagattcaataaattatcaaaacacgaaaatagatacacatttgtgtacctattttttactatttcaccatcgtggcggacgtggtggcggtcctgggggtcgtggccctggtcctgggggacctggctgccatggtggtcgtggtcccggtcctggtgggcctggctgccatggtggtcgtggtcccggtcccggtgggcctggctgccatggtggtcccggttgccatggtggaggaaataaccaccaaaaccaaaatggaataattggctgccgactatctaactgattatcaatcatgtaatattcatcttgaagcggatccatttaaacacctcactttattatacaatatgtatccctttaaagaaggcatgggcttttaccaatcaagattaactttttttcctttacgataatattctttatcataatcattaatttcgcgaattactcggcatggtaccccataagcaacagaatttgctggaatatcttgggttacaacactaccagctccaataacactattgtcaccaatcgtaacccccggtaaaataacactatttgcaccgatccaaacatcatccccaattacaatcggcaatgaaaattgcgttccacctcttcgatattccggatcaacaggatgaccagttactgataatgtaacatttggagcaaccattacattgttaccaatatgaacttcaatatcatcaacaacaaccaaattaaaattagcataaaaattttcaccaatataggtattacagccgtaggcaaaataagcgggagcttcaatccatatattttcaccagcatggcctagtaaccctcttaaaatatcctgtttttcttttttattatcaggatgacaatgattatactcgaacattcttgctttacaatttaatctttgacgttcaatttctttttcatactcttgatcttctatattttcatggccaaattcccgatataattgaccgttcttcattttatcttttaataacatatatcctccttatgataaacacccagctaagctgggtgtcatatccttaatattatttaacacgaactaactctaaatagctagtatcccctttaagtcctggtttaccaccagtaactaaaataagttctcccgattcaacaccattttcttttgcaatgatttcagcataatccatcatacttgaacgtgttttcattgttttgcattttactggttttactccccagttaattgcaagggctctagtagttgctacttcaggtgtagcagcaatgatccgagcttcaggacgataacgagacatttttcgagcagtaaatccactttcagtaaaagcaataatcgctgcaacttggaatttagaggcaatttctgcaactgacatacaaatagcttcagatgtatcttgtggagcagttcttacagcttgacgatgtaatgcatcataatctaagctattttctgtttttaaagcaatcttactcattgtcattactgcttcttgtggatataggcctgatgcagattccccagatagcatgattgcatctgttccatcaaaaatagcattggcaacatcacttacttctgcacgagtcgggcgaggattttgctgcatactttcaagcatttgagtagcagtaataactaattttcccatatccttacatttcgtaatgacttccttttgaatcaatgggacatcctctgcaggtacttcaactcctaaatcaccacgggcaaccataatcccatcagctatttttagaatctcatctatgttttcaacaccttcgctattttcaatcttagcaatgatttgaatatcaggtcgaccattttcaaccaaaagtttttttacatcaaatacatcttgtgcacgtcttacaaaagaagcagccacataattgaatggttgtgtacatccataagttaaatcatcaatatcttttggtgatagataatcgaaacctaatttaattcccggtacattgattccccttttattttttacaattccgttattagcacaaacacatacaatgtctgtaccttcaacatgatcaactagcaattccacttgaccgtcatttaccaaaataaacccaccaggttttacatccttatataattctttataagtgattgtaaaacgatcacttgttccgacaatatcttcttgacaaattgtgacaacctgaccttttttaaattcagttgaaccatcgataaaatcacctgttctaatttccggccctttagtatctaataaaatagcaacgcttgtatccaactccttattgatttcagtaatcaaatcaatttttgcctgatgctcaggatgagttccatgagaaaaattaagtctcattacattcattccagctttaactaatttagttaacatctctttgttatctgatgctggtcctatcgtacatacaatttttgttttactcattacttcgttttttagcatatcgtcattaccatccttttccttctcaatttatcatacatgtttattatagcccatctaaaaaacacttgcgagacttttgataacatttatcaaaagatttttagttgattaacgcttacaaatttcgaaagcgtattcaacatcttcttcacctttaatacagtattcttcgagtattggagcaccccaactatcatcaccgccaacacccatttgagcagctaaaatagttacaaaggtaaaatatgattttggtaattcttcttgatgcattgcagcttctaaagtctgcaagctatatggaagaacagttgcttcgaatggctgatcgatcattttgaaacaaattccttgatctttttcatcagttattgctaaataacgcaaatcacagcgatttccacattcttgtggaactaaatatggcgataagttatccttaacaagacaatcataaacatcaatttttgctccatccttacgatcaatataattttctaaaggtccacgacctaaatattcaaaacgatcaacttgatcatacagtttaaaacacattcctattaatggtaattctggtaatcctgcttttccatgataatgataatcaaccctaataatacctggtgcccgtactgtaaagactatatcaacagtagttgcaggaattaccggtaaagtatactcaaaaaatacttttacactactataatcagaggcaacttcataattaaacttagtacaattataaaaagttgaagccccaaaccacattgaactattcacctcatgtttatacccgcgttcattatcagttgatgctcggctaaaaacaggacgtggagctcttgcgatatattcatggttcccatattttaatgaaattaatccttcactattagcaaacatcacttcaaaatcattgtatcttataccgatattaccatcaccaataataacttttagcggttgtttagaaactgagagcggtttatattcaccaactatagtttgaccgaaagcaacttcaaaaccagctttagcccaaatttgatcatctttcaataaagcactaactgtcttaacagcttctttatctaattttgttaaccacggaatcaatatttctttagagtctccaggttttacatcggctatgaaacatccctcctgtaaaacttttttaccttgttttaattgataaacaaattgatatttactagtattactaaacatcattttatttgtaattatgacacctgcatctgtcggcttaataataatatcttgatataaatatttaacttcttgagcttttggcgaaatagtacgatcagcaaaaacaattccatcgccacagaaattataatcagtatagcgttctttaaaatctccaccataaccaagaactttttcatcataaccatttgtatagtacactgcctgatcaatatagtcccaaataaaaccaccttgatattgagcatacttatcttctaaatcagtataatgtttcattccacctagagagtttcccatagcatgcatatattcacaactaatatacggttttgcaggattgccctgtaaatatgtttcaatttctttcgcttttgcatacatacgtgattccatgtcagttgcttcacaataatcacgattccatacacaaccttcataatgaactaaacgagtcggatcattttctctaaaatgattagccatagcaacaatatttgttcccgcgtatgattcattaccacatgaccaaattaaaatcgaaggatgatttttatcacgttgtagcattgtattagcacgatcaacaacgacatcatgccattgtggcaggtttcctggaatattccatgacggttcacaagcacctaatttttgccatgaaccatgactctctaaatttgcttcatcaattaaataaattccatactcatcacatagatcataccacaatgattgatttggataatgagatgttcttactgcattaatgttatgcattttcataaatttgatatcgtatagcatatcctcttttgtaatagcccgacctttatcagcagcaaattcatgacgattaacacctctaaagacaattctttgaccatttaacttcattatcccttgatccattttaaactctctaaatccaattttttgtggtataacttctactaaattatcatcatgatcataaacggttaacaatagtttatacaaatatggattttcacttgaccataaattaacattagtcagtccaaacgaaaaattagttaatggcaattgctttgcttgataaataatattattattctgatcatataaagcagtatttagatagccctcttttttagcaattacatctaaattgaccgatacctggacatctttataattattttttaaagtagtcttaacaaacagatcattaatatgaatgtcttctatagcatataaacttacatctctaaaaatccctgaaaagcgccaaaaatcctgatcttctaaccagctggcactagagcgtttataaacctcaaccgctaatttattttcaccatcttttaaagcataagttacatcaaaacttgatggcgtaaatgaatcctcactataaccaataaattctccatttagccaaacataataagccgtttcaactccatcaaaaaccagacgagttgttttattctttaatgcttcatttacttcaaaatagcaaacgtaacttcctacaggattatcgtcacttgatatatgtggtggtcttaatttctcatgcccatcccatgggtataaagtattaatatactgcatctgatcataaccttgcatttgaatatgacctggtacatcgatcatatcaaaataatgacaatcaatatcctctttataaaaatcaacaaatctttcattaggatttttagcataattaaaataccagcgtccatttaaagactgctttaattccattgcatctccattcaatgctttatcaatatcgagataataagaatgatcactataagcatttaagcgatttaccgcaaaaactttaggatctgctaaccaatttaaatctgcttgtgttcctttcataatagcctccaattttacttatattttagtgaaatacatatatattttactaaaatataataaatttttcaattcttttaataagataattatttatattttatataaataattatcttccggctaagctgaagattttcatgtgcaggtatacagagtaaatgctaaagttccttcatttcatgcaatctgtctctaccacttacgctaattcttattttaaatcaagtacaagttattccaccttttaattgactctttatatattctttgtaacttttcctattataactacataattttctctgcactaaagctttttcttgacccatagattatctgtgaattttattgcatacaaaaagcgacttatcctgtcgcctttcttatttttatgtaattatttcaacttatcattgataaaacgcttgaagaaaatcgcgttagttcctgttgttaataaatcagatactggttctgccagcattaccgctaatacaccattgctaatgaaattaggtaaaatataaatcaaaggaattaataaaattatcttgcgatagaaagcaaagaaaaatgatctttttccttcgcccaatgatgtatagatttgttgaaaagagctattagcaccaataataatatagccaaagatatacactcttaacatctttacccccaattccattagttctggatcgttagtaaacatgctaacaaaaagcgccgggaacaactccatcaaagttaccattattactgaaaatgtcaaggccaccttaattaccattttgattgcctcaataactcgttctttttgtctagcaccataattaaaagaaattatcggctggctcccttgggctattccttccattggtaaaaagacaatttgggccattgaagccataattgtcatagaactaacggcaatatcaccgccaaaaaataataattgtcgattaaaacatacttgtaagattccctccgtactattcataaaaaatggtgaaatccctaaacccaatactcttttcataattattttatcaaagaacaagtattctttctttatttttattgttgaccgtttcgaaaaaataaaatgcattacccataaaaaagaaacaaattgcgaaatgatcgtagccaaggccgctcccgctactcccatatttaaagtaaaaataaaaattggatctagaataatatttaacgcgcctccaataactaacgttaacattccaaacttcgcatacccttggcaattaataaaataattcattcccacacttaattgtacaaaaatcgtccccaataaataaatatttaaataatctttggcatatgataacgtatttgcacttgcaccaaacaataataaaatttcttcaccaaatatatataaaacaatcatgataactattgaacttaatactaaagaactaaaacaatttgagattattttatttgcttggtcattttcatcagctcctagacttattgaagctaatggtgccccaccacggccaaacaaattagtaaaagcggtaattattgtaataattgcactacacaaaccaattccagcaattgctaaagctccatcctccattcttccaatataaattcgatccactaaattgtatagcaaggttaccatttgtgctaagatcgatggtatcgccagtgataacagtaactttgaaattttttcattagcaagtcgctcattcattgttattccctcctaaattttcataaatttggctaattaatcggttaaactgttctttatcttgatcacttaacccctgataagcaatttcattataattatcttgaacagcccgaatttctttaatcagctcattagcatatggtgttacaaacaaacaattacaacgacgattttcattatctacttggcgttcaacgaaccctcttttgactagtttgtcaagcgaacaagaaacatacgccttagaaataccacggatattgacaatatcttgagcatgatgatactcaggattattagctaaaaatgccaatacatcaatttcaatttgagtgatttgatactttttttgtattgtttcaaacataatattatattgctttaataaataaggataaattgccattaaaaaggttttcttcatttctctactcctaactgttcgttaatgaacagttctataataaactatttattatgaataaattacattttttcacaataagaaaaaactaatatttgttgaaagttaaacaaatattattagggtggttatctttaaatataacaacaaaaatactttatcgtagattaaaaaacaatgagctatatcatttgttatccatttttcatagcggtataatatgaatatagaaaatgagttaatcatatatagcttgaaaggaggatgctatatgacaaattggcaaatagtgaatcatcgcttgcaaaatctatcattacataatctaaaagaaatctgttatgcacataatatttctatggaagaacgtgacctagagttaattcttcaaataattaaaaataacccatattcaatcgtaaatgaagaatatactccgattttgtttattgagatttccaatgtgacgaataaagctacctgtgacaaatttaagccaattatcgaaaaggaatatttgattcactaataaaaagcacctaataaaattaggcgctttttaatatcattaaaaatagggttactatcttctaaactttctgttatattttctaaaagattccgtaaacacattatactcttcattaggaatatcttcaccttgaacaatcctatcaatgaccggtttgttttcttccatcattttacgcgcatattcttcggcagtattatttcctttactaatatttaagatataattacaaacttgttcatacatatcttctccggtaaacagttcccactgttgacaattttttacatctaaaatatttattataattctagctattaactctctatctttcatttttatcaccgctcaatattatcccacaaatgacaatcaagttcaaatcatagataaaatttttaaaagttgtataatataaatgagcataagattgtcctcccgttgacaaactatgctcattttttcaatattttcattgagaataattggtaaaatagttgaaataatcacatcataatcaataatactaaaaatatttaatttaccccatattcatcgtcatacaataacttaattctcttattgacatttccaaataataatccaccattttccccttgaaccatttctacaataaatttaattgcgagcaccttttatattattcgtgcaaaaaatttaattatctccttttttttattaaagatataaaaaacaatctgcttatcaaaaatatttttaaggaaaaataacttatttcccagatcaattgtctaattaaatcctagttatttcaaatgattaaaaatagctatatttcaaaaatttatcattggccatttaaagcttatacagatcacaatcctcaatttttcctcatttataacatcaagcttgataacttctatttcctaattttactataaacaaagaatatttgtaataattaccaaatttaaaaagtacaaactgttttcacctaatttgtactttttaaactttatttcttttctcattaaacacagagataaaaaatactaatctaatattaataaaaaagattactattgtatgatttatctagtttaacgacggcatcataatattagtttccttttagcgtatttagctgcaccatacattcccgcttgttccccaagttctgcaaccactagatcacagttattactagcaatttccaaagcatgaatagcagcaacctctcgagttgaagctaataaccgctctcctgcatttgatactccaccaccaataataatacgttcaggattaaataagttaataaggttagttatcccataaccaagtatttctcctgtctctttaagagtcgcaacgacaatcgaatcatttaaatcataagcttggcagatcatctttgcagtgatctcatcacaattatttacccatctattaacaatactcatatgatcaatatccttttctttaaacgtattgatcattccaactgcagaaacgtacctacccaagcacccactactaccacaacgacaagctctcccatgacgatacatattcatatgcccaatttctccgacactgtcatttgcaccgtataaaacatgtccatctactacgattccagaacctaaatcggtcccaattgcaattaaaataatatttttaaaacctttcccagctccaaaatacaattcttcataaagatgcattctaacatcattatcaattacagttggaatcagccacttatgttcaaaccattctttgatcttgacattgtgccaattattaaaattaggagaaaataaagaaataccgtcatttcgatttaacaaacccggtactcctatacctagagcatctatctgttcaaatgaaagattattctttaaaactaatatttctaaacatttttcaattctttttaaaactatatctgcacccaaacttgctcctgtatttttttgaaccatttttaataattgtaactgttcatcaaagagtcctgctttaatagttgttccgcccaagtctactcccaaataatacatttttcctcctattaaaaaagggcatttctatagtgaagctccattattttaatatgctcaaataacagagttcactttcttctgcccaacttttaaattacttttttaccgccatacttgcgaacttttaatacatgacagcttcctttaccaaaaactctttcaatttcagtcttataagcagttacaaattcatctttaacaaaagcttgaatcgttcccgcaaaaccaccaccatgaacccgacaaacgccatttcggccaataattttttctgacatggctaatccaattgaaacactttgattctgaacatcgcagtttgcatacacattttgcaagaacttataagaactatctccagattccttaacaacttttttaaatgtttcaaaatcactattgtttaaagccttaacttcttgatcaacccgtttattttcttcaaataaatgaattgctcttaaaactgcccggtcttgacaagcttttctagcacctgctatatcattaaagaaatcttcctcatctacttcacgtaaaaattctttaccaaaatagttagctacttttttcatttccataggaattgctgcatattcatcagttaaatcagcatgtgatccttttgtatcaacaatacataaactgtgtccaaatttagaaaaatcaacatctactttattaacaattggcttagccacatcattaaaatcaatattaatcaagctacctactgaactagcacattgatccattaaaccacaaggtttaccaaagtatacattttcagcatattgaccaacttgagcaattacaacagggtcaatagtcatatcattatataaaccagaaataatagtaccaataatcgtttcaaaagctgctgaagatgataatcctgctcccattaatacatcactagtaataaaagcattaaaaccaccaacattatatcctaattcttttaaccgagcacataccccacgaattaaagcctcagatgttccttcttcagccttttttatttctaagtcttctaaattaattggcgcaatatcaaaatcatcagataatactttaattttattgtcaactcttccaacaacagcgattgcatcaagattaactgctgctgctaaaacacaaccatgctgatgatctgtatgatttcctcctacttcgctacgtcctggagcactgtaaatttctacatcggtatcaccatacaatgatacatatttattgattgctttaacatatcgctcacgttgataatctaaaagatttgtatctgcataaatatcatttaataactcatcatactttttattatttaattcttctactaaaattgttgctttaatcattattttattacctcaaatttatatgatgttatttcatcatatacttcacctttctttaaaattgttgttgggtcctcttcaatattaattgcatcgggaagattttgagtttcaatacataatgcgaatcttcttggatatacaattccatatttaccgatacgtccatctaaataattagcactataaatttgagctcccggcaatgatgtacttactgtcaatttacgtccagtagcttcatgatataatatagcttggtctttatcttggttaaaaatgaacggatggtcataaccggcacctaatttaagctgctcatcatcactatcaattacatcaccaattcttgtcattgaattaaaatcaaatggagtatcttttactagattaaatttaccagtcggtaatccatcaaaatcaacacatgcatatttatcactatgcactaacaattgatgattataaatatcttctttagcccccgacaaattaaaatacgaatgattagtaatattaataattgtatccttatcactagttgcttgataacgtacaattaaagtatctttatttaaagtgtaaattgctttgaatgctaaattaccaggatatccctcttcaccatcttttgacaaataagtaaactcaattgaatcctcaagtatttgataatcaaatatctgatatgaaaaacctttgaccccaccatgtaaacaattaggaccattattaattggcagcgtataagtttcactgtttaaagtaaacttacctttaccgatacgattagctgttctcccaactaatgcccctaaataagcgtctttagtctgataatctctaaaatcatcataccctagcactacatcatcaatatttccatctttatctttcattaaaactttaacaatcgtacaaccatagtttgaaacaacaacttctaaatcatcatttttcatttgaattagatcaattttatcatcaatcttttcgattacctttatcatcttattctcctttcaaaactgtttccacgaaacttgttaaggcatcaattccataatcatccattttaaaaacaccagcatcttctaatacattaacaaatttaattgctactgcttccttcaagatttcatcaatatttgtctctgtaaattcatgttgcgctaacaactgttgataccatgaatggtgtttatctaattctggatattcttcaatctttgcttttttcaataaacagtcacttaataattttaattcatcttttaatcgagctggtaaaatagctaaccccattacttcgatcagaccaatattttcttttttaatatgatgtgattcttgatgagggtgaaaaattccatcaggatattttgtacttgtccgattatttcttaagactaaatcaatttgatacttatcacctttacgacgagcaatcggtgtaattgtgttatgcggaatatcctctgtatgcgagattatatctaaaactggagcattataatggcgccagtaatctaacattttcactgataaagcgactaattcttctttattctctgaagttaatcgaactgtcgataatggccatttaaccacttcaatcaatgtacttggatatttatcagaaattagtgtctttaaaacttctgccccttgaattggaaattcataatttccaccttgatagtgatcatgacttaagattgatccaccaacaattggtaaatcagcatttgatccaatcatgtaatgaggaaatatatctaaaaatgaaaacagattcttaaacgtgttctcattaatcaccatcggcttatgttcctcattaaacacaatacaatgctcattataataaacatatggtgaatattgtaaataataatttccagtcgccaattcaattggaataattcgatgagtttgtcgagccgcccgattcaaatcgccactaaaaccaacgttttctttacacaataaacatttaggatatccgcttgatttaatcaatttagctttagcaatttcttttggatctttttccggttttgataaattgatagaaatctcaatatttccatatttaacatactttttccaaataatatttttatccgtacgactctttctaatataattagaagcaattgataatttgtaataataatcagttgctactttaggacttaccatatatttctgcttaaatttttcatttacagtatggggtctaggcataatacaattcattattttagtatcaaatagatctctacttgtggtattatcctcaattaatccttttgttactgcatgatccaacatcttttctaagataggtgtcgctaacggtaagtgttcactaatctcttcatattcaaagtcattttcatcaaataaatctaataataggtttactgaataatcacattcatctttagtaatcatctctttgtctaaagcaaactgaattaaccgattaatttcatggttcattatagtaattcctcccttttacacaattatattgtagctctaactataaatattgtcaatcatttttactaaattataagtaaatatttactaatttattgactaatgtttactaaagaattataatagcgttgtaaaaataaaaaagggggactcaaaatgagtatattagtattaggtggtgctggctatattggaagccatactgtatatcaattaatcgaaaatggaaaagaggtagttatcgttgataaccttcaaactggttttaaagaattgattcatcctaaagccaagttttatcaaggagatctacgtgataaaacatttttaaataatgtttttgaacaagaaaaaattgatggtgtaattcattttgccgccaattcattagttggtgttagtatgaaagagccattagaatattatgataataatgtttatggcatgattgttttacttgaagtaatgaaaaatcatagtgtaaaacatattgtcttttcttctactgctgcaacttatggtgaacctaaacgtattccaatcgaggaagacgatgaaacatatccaactaatccatacggagaaactaaattagcaatggaaaaattgatgaaatggtgttctagcgcttatggaatgagttttgtagctttaagatattttaatgcttgcggtgcccatccaaatggtaaaattggtgaacttcataatcctgagacacacttgattccattaattttacaagtcccattaggaattagagaaagtatttatgtatttggtgatgattatgatactaaagatggtacctgtattcgtgattatattcatgtaatggatcttgccgatgcgcatatcaaggctttaaattatttaaaagctggaaatccaagcaatatatttaacttaggtaatggtgagggctattcagttttagaaattatcaacgctgccaaaaaagttacaaatctgcctattgcagttacaaaggcggcacgtcgtgctggtgatcctgcaaaattagttgctaataatacaaaggcaaaagaaatattaggttgggaacctaaatatactgacatagaaaaaataatttctaccgcttggaacttttatattggccgaaaataggttataatattaagtacatcaaggagggtaatcatggctacaattaaagatgttgcagagctagcaaatgtttccagtgccactgtttcaagaattttaaacaatgataaaacattatctgttcctgaagagacaaggcaggcggtatttaatgcagctaaagaattaaactatataaagaaaagaaaggcaaccaaaaatgaattcacgattggaattgttcaatggtattcattgcaacaagaaattgatgacccttattatttacaaataagacaaggtatcgagaacttttgcttacaaaataatataaatgttattagaacttttagagccgatcaaaactatctagatgttttgaaaggtgtagatggcctagtttgtgttggtaagtttaataataatgaaatttctcaatttaaaaaaatttcaaataaagttatctttctagatatgcatagtccaaatagtgatgacagtacgatcactttagacttccacaaagcggttattgatgctttagattatttaaaatctttaaatcatcataagatcggttatttaggcggtaaagaatatcttgaagacaatgttgtatatcaagatgctcgtaaagaaatatttattgattattgtaacaaaaataagattatttacaaaaaatatttacttgaaggtgaatttacaactgaatctggttattccatgatgatggatctgatcaatcaaaaagatttaccatcagcgattttttgtgccagcgatccaatcgcaattggggctcttagagctcttcaagaacacaatctcagtgttccaagagatatttcactagttggttttgatgatattaaggcagccagcttcactaatccaccactgacaacaatttatgctccagcatcacttatgggggaatatggagcaagtatggtatataatattttaagcaaatataattctcctactccaatgagaataacactcccatgtactttaattgaacgagagtcttgtaaaaaagtagattaaatctactttttttatttattaatttattctctctaaataatacaataaaatactaatttggcataaataaaaaataaaggtgcataatatttgtatccatcatcattccatgttaagatttatacagttagcaagagctaacctaaataactataaatctttgtcgacaaaaggtaataaaaatagtaaaggagtgaaacacaatggataaacaattaaataaactattagcagatttagtagttgaataccacaaattacaaagttatcactggtatattaaaggaaaagatttctttactgtccatgcaaaattagaagaactatataacggagttaataaagccattgatgaagttgcggaagctatcttgatgactggttttaaaccagcagcatcaatgcaagaattcttagatatttctgcaattgaagaagtcaaaggtgaacatattacatcaaaagatatctataaagtagttctaaatgattttaattatttattagataggattaaatcattaaaaaataatgcagataatgaaaataattatttaatttcatctttaatggatgattatattaaagaattcacaaaatctatttggatgataagccaagtagttgaaaattaataaaaaaaaaggagaaaaacaatgtcattaatcggaaaagaaataacagaatttgaggctcaagcctttcatgaaaatgaatttaaaacaatcaaaaaagaagatttattaggaaaatggaatgtcttattcttctatcctgcagattttacatttgtctgcccaactgaattagaggatttggcaaataaatacgaagaatttaaaaatataaattgtgaaatttattcagtatcatgtgatactcatttcgttcataaagcttggcacgatacatctaaaacaattaagaaaatcaattatccaatgttagctgatcctactgctaaattagcaaaagatctagatgtatatattgaagctgatggtttagcagaacgtggaagtttcatcattaatccagaaggaaaagttgttatgtatgaagtaatcgctggaaacgttggacgtaatgccgatgaattatttagacgtgttcaagcttcacaatttgtttatgagcacggtgatgaagtatgtccagcaaaatggaaaccaggagaagaaacattaaaaccatcactagatctagtaggattaatctaaaatgtctaatctttatgatgctattatcgttggcggtggtcctgctggactatccgctgcgatatatctagctagagctaaattttcagttcttgtaattgaaaaagaaaaaatcggtggtcaaataacaattacttctgaagttgttaattatcctggaattttacaaactagcggtcaagagctaacagaagcaatgcgacaacaggcacaaaattttggtgcagaattcctacttgcaacggttaaagggatcaatttgaaagaaccagtaaaaaaaatcatcactgataaaggtgaattttcaagtattgggattgttttagcaacaggttctcatccacgtaaactaggttttccaggcgaaaaagaatttcaaggtcatggtgtagcctattgtgctacttgtgatggtgagttctttaccggtaaagatatttttgtcattggcggtggctttgctgctgcagaagaagccgtgtttttaaccaaatatgctcgtaaagttacaatcattgtccgtgaggaagatttcacttgtgctaaacaagttagcgataaagctaaaaatcatccaaatatcgaagttcattataacacggaaataattgaggctaaaggtaatcaccagttagaacaagcaacgtttaaaaacaacgcaaccggtgaaacttggtcatatcatgccgaagcaaataacacatttggaatctttgtatttgcaggttatgagccagcaactgaaatattcaaaaatcaagttgaattaaataactatggaaacttaattgtcgatcaaaatcaaaaaactaatcttgatggtgtttatggagctggtgacgtttgtgtcaaagaattacgtcaggttgtcactgcagtcagtgatggcgctactgctgcgacctcattagaaaagtatatccctaatattgttactgctttaaaactttcccccaagaaaataaagattaaagaagcagtacaaacaagcaaagaaacaagtgaaaatgatgatagttttattacccccaaaataaaacaacagttggctccaatttttgctaaattagaaaaacaattaataattaaatgctccctcgatcatagtaaacttgctggtgaaatcaaatcatttattgaagaatttactactctcagtgacaaactttcctatcagttcgaagaatcaaactcttcaccagcaatgcgtttctatgatgaaaataataattatttaaatattagttatcatgctgttcctggtggtcatgaatttaattcctttgtaattgcaatctataatgcagttggtcctaaacaaccgcttgatacgcaaatcatcaatgaaattaaacaaattaacaaaccaaccaacattaaggtagttgtctccctttcttgtactatgtgcccagatgtagtaatggcaagccaaagaattgcaattgaaaataataatgttgatgcccatgtatttgatttggcacatttccccgaacttaaagaacaatatcaaattatgtcagttccttgtatgatcataaatgatcaagatgtgtattttggtaaaaaagatatccagcaagttattgaaattataaaaaagtaagcttacgcttactttttttaacgatataaataactacctaacggtgctttcatatggtctactacataaccgcttcctccacgattttttacatcttcaaccatcgttgtgattaaaaccggattatcactatttgttgtcattactgtaaaccagccaatctcactaccacttgtatcattttgtgaagattttaattctgctgtcccagtcttaccggctaattcgatatcttgatgataaatcgaatgcccagttccattactatcactgatcactcctactaaagcctctttgattctcttaactgtatctttgctaaaaacatctttgatccatgcatcattaggtttttcatcaataactaaataaggctgagcaatcgtcccctcattaacaaacgctccatatattgatgctaactgtacagggtttaataataattgaccttgcccgtagccactgtcagctaattgttgatcatcaaatttactatctttattttgatattgagaagcatttaaagataattcaaaaggtatttttgatccaatctttaatttctcatatccctcaatcaacttttcctttcctatttcactagcagctcgagcaaaataaacattatcagaatagataattgcattattcaaattattaggctttggagcatgaagtgttgttacataataattaccccaactagaatctttctgccacttatccttagctccaaaatcttcatctggatctatcttattactttctaaaccaattgctgcagtaattggcttcatactagagccaggaatatatgtccctctaaaacgatttgttaaaggtttattagcatcatcatttaatgcttgccattcagcactactaaaaccaaaaataaaatcattacttgaaaacgacggtgttgatactaaggctaaaatctcacctgtctttggattcatagctaccgaagcactcttatcattttgatattctttatacaaagattgttgcaaatcagcatcaatcgttaattttatatctttaccattttcaacttttttagtagctaatgtttctactaatttattatttttatcaataattataatttctttaccatcagttccttttaaatctgcttcataagcagcctcaattccacttcgcccaattaaagaagtttcactatagccttcatttttatgtttcttcaaatcctcagcatttacttgctgcaaatatcctgtaacatgtgaagcagcttctccataaggataataacgaacacttacagtatttagcttaactcctttgattgttaatagttgttgagctttagcttttccttcttcatcttttgccatctcttttaacggtacgaacgaatcatctttgatccatgaagcactcattactttttttatttcatcacgactcattccaattattttgccaattgcttcataatcagcttctccatttagtttgccttggactaaaccaacagaataagcctcccctttagttgcaagttctttaccatttcgatccaaaatttttccccgactagcactatcagtattaatttttatcttataatcttcttttaatccttccaagatcatcgcttcattataaacaagctccccatcttttacttcaactttattttcagaacttatttttcctgccaaagtatccatcgttaaagtataattaacaatcccatcttcaacctcgccaattttaatttcaatatttttagcttcaatcccctcataaatatttttatatctagcctcaaatactttttgactcgttttagcaagtgagccctttgttaacatattatacatttttccatattctttattttctaaataaccataatattcttttacataatcatcagcacttttaccccgtgaaaaaataaaaaaaactgcacctataattaatgcaactgccacaacaccaataatgattaattttctccgatctttcaataacatacatttccctctttcctagctaattagtattatctagataatattttagcataattttgataactaaacagcattgtttataatttaataattatatcagcattcaataaacaattcgcaaatacatcatacgtcttatgtgatagtgtgctataataagatttatataggaggatatttagatgaacatattagtattatcaagattaaaaacagatgaaataaataaactagaaaaaagttttccggatttttcatttacatacagtaaggaaaaagaagtgacccaaacaatgattgacaattgtgatattttagtcggtaatccagggaagcatgtggaacttaatcgtcccaatcttaaagcaatactactgaatagtgctggcagtgactattatattcaagaaggtgttctacatgcggcaacacgtcttgccaatgctagcggcagttatggtaaagcaatcgctgaacatactatcggaatgatgctagcattaaataaaaattttaaaaactatattaataatatgcatgaacattcgtggaaaagctaccgtggcggaaaagaaatttatcatagtaccgtaatcattgttggactaggagatctaggttatgaacttgctaaacgtttaaaagcttttgagtgcaaaacgatcggtataaaaaggaatgtttctccaatacctagggatattgatgaattatatacgattgataaacttgaagaaatcttaccccatggtgactttatcatttcatgtttacctcaatctacagaaaccattaatctttttaacaaaaaacgcctattaatgatgaaatctgatgcattgtttgttaacgttggtcgtggtagtgctgtaaatactcaggatttaaaagaggttcttaaagctggacatttgtatggtgcagcgcttgacgtaattgatcctgagccttttaagacagacgatgatctttgggattttgataatgttttaattacaccgcatgtttctggaggatttgagtgggatagtgtccgagaatatttcaccgaattgacaattagaaatattaatcatctaatcaaaaatgaacctttagaaaacgaggttgactttaatactggttatcgtaaagtcgttaaatataatgattaaataataaggactaattctcttgaaccgcccctgtcaagtagacagatgaaataattaaaattattattgaagttgtctcatcgacaacttcattttttctttatgcagctaatattgtgctgcttgtatagtgttctattttatattttattattcttttattttcaggtactggatattgatttggtgtttgtaaagagaatgcctcatttctaacttcatatggtgtcttaactccaaatcttctctaatttctttcatacatgtaataatgaatccaatcatcaacagctttgacaagttcatcttttgtattgtaatattttccgtaatgatacatctcacatttcatgattcccccaaacccttccgttggtccagtatctatgcaacagtgaacccttaacatactttgtgtcataccatgtcccttaagcatgtttataaacactgaacttgtatattaaaaacctctaccactgtggaataaaggacgtgcattaggattatctttaaccgccttatcaaatgtgttaaagacaagtatgttattattgtgatcaccaacttcataaccgacaactattctatcataaagatcaagaaagcttaagttccagttgtccatttcaagttcgtattccttctgcttgagctgacgttttaataatgtaacttcatcaactttttcatcatccttacgacagccacgcttatcacctaaaccatcttctcctttttccttatacttcttaacccagttaaaaacattagcgtaagttgtttcaaacagcttagctgttatcttataatccatatcatgttcaagacagtactttataatttcaatacgttcttccttattgactttctgcttttcaccatatagatatcttctcctccaggaatataatcttttagttctatatgactattatacaattttacccaattttttataggactagatgacggaatacaatattttattgccaaatcatcatatgatcccccaccgttaagataatctaatacgacctatttttttaaattctttgtataagatgcatttgtattagaaatatcaaatgcactttcaccaaatgcattatattttttacccagttgccactatattgcctgatgtatttatttctttggctaaggagatggttgatccttcaccctctaaatatcttttgacaatacttaattttagttcttttaaatatttattttttcttcccaatataaaaacctcctgtatcaatgtttaattatttacactgtctactgggaggttatcatatcatctaattaaattagtctttattttactagttatatatctaatttaatttggcgaactttattcgaagcaacaattcttttattaactttatcatcatatgataaagttcctaacaacatcggactttcatcatcatgaattgccatattttttgcaactaaattatgattacatgcataacaataagaacatccatgattacaacagctatatgcaccaatatcaatactcgctaaacaactacaattggcacgattagtatttgtcttgatatccaagggatatcctatcaacgtttcaatatatcctcgatctaaacaactacctttagcaattccatattcctctaaatgatatttctcactacaagtttgaatatgaagttgatatttttgagcaatttttccaaaccgctgggccaattctattacatcatgatcagttaactcatcaaacttaccaataatatttttgtaaatatcaagaaaactaataattacggtttctgtatacggaaagagcaattggcacattttttcaaacattttataatgaaatacttttgtataacgttgatttaacagaactggatcatagcgccagatcacccgcttttttccaagcatcttacttaattcaataaacgtcttcattatttctagttttggtcttaatcccggttcaatatctaaatcataggcagtaatagtaaccataaaatagtaattgtatcccatgctgtctatttgggtcaaataggggactattgctttgggatctttagtacaaaagcagatgcaatcaacaacttctggagtaacatctacgtgtgagacctgatgctcattataaggatttcgaactaatatgtatcccgcttttaatcgattaacaaaccatttaggataaagtgcacatatatcagttcgtccagagacttgaagtaacattattattctccctttatcaataacagccttattatttggttatttgctgtttttttaactaaatttttctgttgtttctttttgactttaattacaaatcgttgaaacatttctttaaaatatttataaaaaccatttatgacaattgcataaaattttactttttcttcaataatataaatgatcaaagctgaattgttataataatattttttaaacactttctcacctacctcttagctattttatcataatttattacaaatattaacaatcatgatatatcattaaacaattattcatggtatacttttgattatcgaggtgggttatgaacgagcaaaaattaattaatttaatcggtgaaattgggcggcttttattaaaacatggggctgaaatttaccgggttgaagaatcattattgagaatgtgtaaaagttatggttatttaaatgttgaagtatttgctttaccttcatactttactctaacgattgaaatgcatgataatcatacatatactttatcaaaacggactcaacaaaatcgtgttaatttagatatggtctatgaattaaataatctagtccgctatacttgtcaagaatgtcccgactatattcatttaaaaagtaaacttgaaaaaataaaaaacacaccaatcaacatgcccttagtatttctaggttatggattaggaactgggttttttacaactttttttggtggtggaatccacgaaacaattattgctgtaggaattggatttatcttatatttctttatttggttaatggaaatattagaaataaataatcttgtcagtacattgttatcaagcatggttttaactgccatagcaataatttctttaaaattaggtttaataaccaatttacagtctactatcattggctgtttaatgattttaactcctggggttgctattaccaatagtttaagagatattatgggtagtgatcatatttcaggaatggcacgaatgttagaggctttattaacagccacttttattgcaattggggttggaacaatgatgatggtcttaggagggtaatatgcaaagtataattgaatgttttagtgctttcattgcatgtctcgggtttgcttttatttttcgtattcatcagcatccacgctttgctataatcgggtcaatcggcggggcattaggctggttagtctatttgcttgcttcaaattttaaaagtgaaatcagctgttattttttagcaatggcatttgttgctttattttctgagatatccgcccgaatctataaagctcctgccacaatttttttaattatcggctgtttccccctggttcctggacgtggaatctatcaaacaatgctatactgtacgcaaggtaacagtgaattatttttagatagctttttaaatacactagcgatttctgctagtcttgctttagcaatcttgattatttcaactattttcaaagtaatcaaaaaattatcatgtcgtaaaataaaggtgaactcatgaaagtactaggtctaattgtcgaatacaatccttttcatcaaggacatttatatcatatcaataaagcaaaacaactaattaaaccagatgttacgatcgtaataatgtctggacattttgttcaacgcggtgagccagcaattagtaacaagtggacaagagcaggagttgcaattaaaaatggcattgacttagtaattgagctgccatttgtttatagtgttcaaagtgctgattattttgcccaaggagcaattgaattattagcaaagctaaaagtcactgatattgtttttggaagcgaatgtggaaatatcaatattttcaaagatattgccttcacgattaaaaataatcaaaagaattatgataacttagtaaaaaaacagatgaatcagggtttgcgttatccagatgcctgtaatcaggcactatctattttaatgaataaaactgttactacccctaatgacttattagggcttgcctatgttaaagaagtaattaatcataattatcctattgaattacactgtattaaaagaacaaatgatttccatagtttggacatcgaatcaattagttcagcaagtgctatccgtcatgctttaaaaaataaaattgatatatcaaatcagttttgtaactatgaagactatcaagaattttacttttttgatgacttttatcccttccttcgttataaaattttaactactgatgcgccaacattaaaacatttgcatttagtcgacgaaggaattgaaaatttacttaaagaaaaagtagttatcactaatcatatggatgaattaataacaagccttacttcgaaacgttatacacgctcacgaattcagcgcatgttaattcatatcttgatgaataatagtaaagaagatattgctgaagcaatgcaaatcgactatattcgagtattaaagatgaataatgttgggcaggcttatttaaacaaaataaaaaaaagctgtgaatataaattagtcactaatttttccagttatcatcatcccgcacttgaattagaatttagagcaacaaaattattatcctgtttatcaaaaaatccaaatcagcttatatcattagaatataaaagtatcccaaaatagaagcctaaaatgaaatgaacctctattatttagaatgtgatgtgtgtccaagcaacgaggttcacttcaaaaaacttctattttatcattaatttcctttaaaatttcttgatcaaaatctaatgtcttaactatcgcgattgcatttccaacagtacaaactcccttcttaataaggtaatcaaaaacgattttattatcttttttaatatcattaaaacaatatttatctacttgatcaaagacttctgttaattcaatatcatgagtagtaataatcgtcatagaattgcatttaaataaatatttcattaatgccagcgcaataataattcgctctttttcatttgtcccctttaaaatctcatcaattaagattaatgatttttgcttattagcaaattcagtaatttgctttaaacgtttgatttctttaacataaaaactatctccattcataatatcatccttcatatgaattgatgagatcaaagcaaacggataatatttaaattcctttgcaaaactaatatttaaggtttttgctaacaacaaattggcacctaacattttcaaaaacgtagatttcccagaggcattgctaccagtaacaatcgtatcatttgatattacaacagtatttttaatcggtttttctatcaataaatgatacccctctactatctcaactctttcatcttttaatatgattggtatacaagtatcataaagactacgaataaccttaatcataatacatacatccaacaaaccgatattctcataaagaaccatgatatcattttgtacttgatctactttcctactaagtttaactgcttgaaatatatcaataaagaataatgatttcattaactccaaaatattgaaaatatcaaactgttttattttattaaaataatatgttgtttttgtcattttcttcaaatggataaatgagttcattactaaagtctgatttgaatcaggataaatatttatttttaataatttattggtaatttgaagcatatcattaattaatgatatctgaagactaatttttcctgttttttgagataattgggtattcattaaaatgctcaataataacattataacaacagaataaacattctctatatcaattattgctgctattatactaaccacatcaagtatcaaaaacagccctgctaataaacacgatttagctgaaatatttagcaagcttcttttaatagataagatcggtacatatgctttattaagtttattcagctgataaatactctctgctaattttttttgacaattcaatttatcaataatactttcttgagtatctaaattattattttctctaaaaaataaattatacaagtactcatttcctatctcactataagtaaaattaattttctttaaaatttgcggcatttcaaaatctataaaagtttcttcgtcaatacttcgttctttattataatgataatactctttagtaaaatcccgatactgcacaccaactcctaaattatattgatggatcaaatatttcttcgtaactaatatttttaagaaacctaatactcctgcaatcaacacgatacttataataattaaccaaatcatttatctttcctcttatattcttgcaacttttgatacaattgataaaaaaatttacgcgattgcggataatgcaataaagccgtactacaaattaaaataagtagataaataataattattatttccccagatatcctacctcttccacatatgcttatagttgtaaaaaatgtaaagacaacaattagtattttttcaaaatcaacatatatatttttatctttgatttcttcttttgattcacgaattaataattctcgatattcttctatattctcaataatttcattttgaataaaatcatttttaactagatcaagatattgaatctttttttgtaaatcataatctctaatttttaattcactaagcttattatcaaaaaaacaatattcattattaataatgatatcctttatctcactcaaagagaaatcaagagaacgtaaaattttaatttgttttagagttttaatttcttcctctccataaagacgatatccattgctatttttattgggtctaagtaaacctttctcttcatataaattaattgcttttttagtaatttttaaataatctgaaacttcaccaatattcatattattccccctactatcactagtataaacctatacctaggggaatagtcaattggaataacaataataatttaataaattctaactagaattgcaatgaagccagtatccctgtatcattaaagtaaagaaagcaggtgttaactatggaatatccacgacctcaattaaaaagaaatagttttttcagtttaaatggagtttggcaattaaatgatctcagtattaatattccctatcctcctcaagcaccactatctaattatcatggaataataaatgatacattagtataccaaaaggatttcattttacctatagacttctatcatgcaaataaccaggttctcctccattttggtgctgtagatcaacttactaaagtatatgtaaataatcgatatattggttctcactcaggaggatatttacctttttattttgatatatcttcatcacttaatgatggcgtaaataaattagtggtgaaagttacagactccttatcgcatgattacccctacggtaaacaaagtcgtgaaagccatggaatgtggtatactcaagtatccggaatttggcagacagtctgggtagaagccgtttcaaaaaattgtattaaagatctgttaattaccccctcattaaccggcattaatttaaaagtaaatactgaggccagtcgatatactgttactattgaaaataatgattttaaaaagacttacactgcaaaagatactgatatcaccattgataaccctcattattggactcccgatgatccttatttatatactttttctataaccactgatgatgattatattgaaagttactttgccttaagaacagttgaaataaaaaaacatcaaatactattaaatgatactcccatttttttgcatggtatcttagatcaaggatattatcatgatggtttatttttaccggaacatcctgatttttacaaaactgagattatgaatataaaaaaactgggattcaatcttattcgtaaacatattaagatcgagccagagctattttattataattgtgataaattaggcattcttgtgatgcaggatatggttaataatggtgaataccgttttatccatgataccgtccttccaactttagggtttataaattttaaagacacacgttacaaaaataccctacaacaaaatatttttaagcaacatatgatcgacacaatcagccatctatataatcaccctagtatcattagttatacaatttttaatgaaggctggggtcaatttaatagtgatgaaatgtatcaaatttgtaaagagttggatccaacaagattttatgatacaacctcagggtggtttagtcaaaaaaatagcgatgttgtcagtcgtcatatttattttcgaaataaaatcttgtcaacaaaccttgaacgtcctctattattaagtgaatgtggcggctatactcggccagtcaataatcatcttaacagcaataaaaaacaatatggctatggtaaaacaaatagcgaaaaagaactaaccgataaaatcgaaaaaatgtaccaagaaatggttataccctcaattaataatggactttgcggttgtatttatactcaaatatctgatattgaaaacgaaatcaatggcctatatacttatgatcggaaaatctgtaaagtcaatcagcaaagaatgagcgaactagcaagaaaactatactcctactatgaaaagaaatcaggtttatcctgatttctttattatttacggaatgatgcaaaaaaacctttttttacatatggagcttttgtaatcgatgtaactttatagccagtagcatcgataaccgcttttaatttatcctcatcaagttcatcagcagtaatgatctctgttctatctttactatgagaggaactgactttcttcactgaaaatgcctttctaatagcatcgttaatatggctttcacacattccacacatcattccatcaatttctaatgtaattttttgcactataaccacctctttagctctattctaatcatggttccaatccttgtcaaataatatgaattacatatttaaaaaaaagaaataaacaaatacgtctatttcttcgctaatttatttttattatgctctaagcactgctccaaaatctttttccacagctgctaaaattttctccattgcagcattaactgttgcttcttctagagttccttttggatcttggaaaagcaagttaattgcaactgatttcttcccagcttcaatatgctcacctgcataaacatcaaaaatttttgtttctttaactagctgtttgctcgcttgaacaatcttacgacaaatatcaaaagtaggaatatcctgatccatcaccatagcaatatctctacttacagaagggtacattgggatttcagtaaatttcactttgcttgtttttaaatttaataatgttgttagattcaactcaacaatgtaaacatctttaacattatatttcttttccatcaatggatgaatatttcctacgaccccaacaacttctttaccaatcataatatacgctgttctacctggatgataatacttatcatcttgactagcccgaactaatttataacgagattcttcaattcccaaatttttaaagattgtttcaacaaacccttttactaaataataatcagctttatatgaaatttgtttaaacggtaaaccattgtattcaccacagcaggcaattgcaagattttgtaattctacacctttagaataagtagttgataattcaaaaatattaacatccttaatattatgtgattgattataattgattacttgtaataacgatccaattatagattttcttgttacacttctttcttcacctaatggcattgctaatttaacagactcatttgtgtgaaaaatattaaagtcatcaaccattactggtgaagttaatgaatacgtcaacgtttcatgtaacccttgatcttttaataagtttctaattaaatgtttctttgcttgaacatctgtcctctttccaacagtcatcgacatctctggtaatgttgaaggaatcttatcgtacccatacatccgtgctacttcttcaattaaatctgcagctaaagtaatatcattacgataagttggtactttcacattaaattcttcaccatcaatagtatactcaaattttagtgcactgaaaatatctttgatttcatcagttgtaattttagttccaagtaccccatttacttttgatgttgttactcgaacaaaacagtctttgatttttagatcagttgttacactttgatatacttcttttgcttctgctaattcaactaataaattagcacatctttctaaaatcattaaagaatttgcagtatttaaagcacctttaatataatgttgtgaggcatcagtcaataagtttaaacgtcgagcagtttctcttaatgttgccccatcaaacgttgctgcttcaataacaatattggttgtattctcatcaattttagtactattagcacccataactccagcaatacaaccaattccagcatcagtggatacaataaggtcagctggttcaattttatattcctcaccatctaacattacttctttacaatcaaatcctgttttaataataaattcctttttatttaatttatcataatcatacatatgaattggttgtcctgtttctaacattacaaaattagaaatatcaacaatattattaattggtttgattccactagcaataagtgcatttcttagccattcaggagattctttagttgttactcccttaactaatttagcaccaaaaaatggacataaatcagtttcaactttaacgctgattccacttccctctgctccgataaatgaaacttctggtaaattaacttcacgacctaaaattgctgctacttcataagctaaagaagtcattgccatacaatcagcacgatttggagtcaaaccaatttccaaaatcgtatcttttaatcccatatattctaatggctcggctccaactggagcatcagtgtctaaaacatgaattccatctttatcttctggttttaaaagtctttgatctaaaccgagttcagcaattgaacaaatcattccattcgactcaactcccctgatcttactctctttaataacaaaaccatcacctaaatcacatcctggattggctacaattactttttgtccagttgccacatttggtgccccacaaacaatctgtctaatttcaccaggtctaacttcaacttggcatacatttaaatgatcactgtctggatgtggcatacactctttaacataaccaattgtcatgttatttcctctagtcaaatcgtgcattccttcaacttccaatccaattgaagtaattttatctgctaattctttaggatcttgatcatcaacctttacatatctatttaatacctttaaactaatatccatctttttactcctttctaccaaactgacttaaaaatctaatatcatcattatagaaattgcggatattatcaatgccgtatttaagcattgcaacccgttcaattccaattccaaatgcaaatccctggtatacttcagagtcaaatccgcacatttctaaaacacgtgggttaaccattccagctcctaagatttctatccatcctgtatgtttacacattggacaacctttaccaccacagttatgacatgaaatatcaacttctactgaaggctcagtaaatggaaaatacgatggacgtaagcgaacctcacgcttttcaccaaagaacttgcgtgcaaatacttctaaagttcctttcaaatcagccatggtaatatttttatcaactactaatccttcacactgcatgaattgatgtgaatgcgttgcatcatcatcatcacggcgatatgttttacctggacaaattactttgattggtccttcaccatttgcagctaacattgtatgtgcttgaactggtgacgtatgagtccgcattaaagtattttcatcaatatagaatgtatcttgcatatcacgagctggatgaccttttggtaaattcattaattcaaagttgaaataatcgctttctacctcaggaccttcagcaatttgatatcccattcccaaaaacaaatcttctaattctgctacaattgttgataaaggatgcaaagacccttggtctaatttaaagcttggtaaagtaatatctattctttcttcgttgattttatctaaaatagcttgattttccaaagcttcttttttatcttcaactgcttttgataattcttgcttaactaggtttgaagtttgaccaaaagtttttctttcttcaggtgccatatctttcatcgatttcattgcttcttgaatcggaccttttttacctagatataaaacgcgaatttcatttaattcttttaaagaagaacagtctgctaatttagctaatgcttcttctttgatttttaataattcattttccatgttttccctcctataatataaaaaatcgttccatataggaacgatttatctcgcggtaccatcctaattcatgatctataatcatgcacttaattaactgtaacgtagcttaaacggcgatgattagtcgcactccaaggtgaattcaataatgctgctgttagaagatttccagcaaatatcttcctctctataacaactttcttacctactagtccttatcaacgtgttattatacctagatattataacgtgtttagcttattttgacaatcattttatgagcataatcataaaaatagagctcttgactgctttaatcgataagcaaagttattcgatagttatattttaaatattaagtttttattcatccaaaccactattttcaaaaaataaagctttataaataatcaacttacgtttaattaaaaccgcttccccaacaataaaaataattgcactaatatccagcattgtaggtaatacaaacgaaactagtaatgtaattataatcaatcctaaatactctttccaaaaacttaaatataattttagataggccttctttttatgcttcataaattgtcgtgaacgttttagtgcccttagattttttacatcacttgtttccattaaatatggaaacattccataattgcaatcaagaaaaacatatgttccgatgacaattactaataaagtaattactattatccaatactgtgctaagattgaaacaatgtccctgccgccaataattccaatatcacaatatgatacaagtaatataaatgcaactataactagagctaaaacaaaaacagcaatcagtgaataaataaaataagtcgtaaaatacttactgatcttctttattccgtaaagtgtatcatcaattgcagataattcttgctgatcaacaatttttaatgatgcgtaaactaacccttgtggcattgttaatgtaattaatcctaaaataagccctagcacttgactaaaaaaattaacggcctgaacaaaaatgacagctgatgtaatcagaagaactgtcttcgttatctctcgaccgttattactaatataattattagcatattcttttattgttttgattgaatacactggcatataaatcccctccctattcatttaattgccctgatcaactctttaattgtttaattttacactgtgttattttaaatatttatctatcttcgtaaaattaacccaatcaataacaatataatataaacacaattaattatatttattatttttatgtgttaatattatctaaattaattataacttagataatataatactgcaactaatatatattataaaaaacagtcacaccgtgactgttacttaaaatgatacatcataatacttcccgcaatagcaacatttaatgattcaatcgtattaattggtatgtatccaatatcatcacatttagcaagaacttctggattcatcccattaccttcattaccaacaacaaaagccatcttactatagcgatttatctgtgcaatattctttccattttcaagtgcactgccaattaccacaacacctttttcttgtaattgcgaaattaattgtgttagattcccataaatacaactaaggtgaaaattggcgccttgcattgagcgaagtaatttatcattatataaatcaacacagttattagataaaataacttgatcaattgaaaaagctaaagcagtacgaatcaaagtaccaatatttccaggatcttgtaaatcatctaaaagcaaataacgtcttccttcttttaattgtatttctttttgcatccggcacttagccataattgactgaggagacttggtaaatgccagtttagccattacttcctcacttacttcaagtacttctaattcactgtcaatatgtttggtactaattagcagttctacttgatttgcttttaatgcctctgtaacaagatgatcgccttcaactaaatatgccttcatttcatcacgatactttttttgttttaatttcatcaatgttttaattgtactattagtggtagaagttatcatattccaatctcctttaactttttctcgcgctctttgtaatccgggagcctcttttgtacttcttgataaaatagctttgagtgattaggctgaataaaatgacatagttcatgaacaattacataatcaatcaattctttttctagatgtactagaaccaaattaaaacaaaccttattttgatttgaaaaacacgctccccaacgagcttttaacttcttaatctgaattaccggcatatttaaactaaaattactttttaaatattctttaattttaaattctaaatatttatttaaaatttgttttaactctcgttctattgtctcttgaacttgacgatgatacacaaataatttattttcatgaaaagctactttgcgttgatttaaatcgcgtacaacaatttgataacgctgattaaagatatacacatagccattattaatatattgatatttaggaagataattcttaatttgttttaaaacgacttgttgattatcacgaatcaatttttctatagcagtaattgaaaaagccgaagaactatttactactactttaccagaaacaatcttcaaataacaacgtttgattggtttaaaatttaattgatactcaataatttgaccgtctaattcaatttgtctaatttccataatttcctcagtataaaatccattaatcttcctatactaataaagatgaggagtgattatatggatattcgtaaagctttattaactaaactgcataatagttcacctgatgaactgaaagaaatcatcaatggcggaattgcttcgaaagaagaaacaattctcccaggtcttggtgtattatttgaagaatattataattctttaaatagtatgcaacaggatgcaatgattcatgctattagcagtttattaaaatagactcttagagcctattttttctttgtttaaattcttctttaattgatcttaataacataaaaataaccaataaaataaagtttaacttaaataattgattaaaatcaattatcaataaaattaccaaaattacaattggaatgatactcccataagcaatcatttctttccctttaataacaagtttaccatgatttttattacgatcttttagtgcatccattacaattttatatatttcaaataacagataattcaagatccatagtaataaaaaatatgcagtagtataaaaattatcagcaaatatcttgataaatgctcttaacggcagcatgttataataatttgttatatcataaacaaaactaaatactgtgattgcaaaagtagctaataaattacgagctagataaataacaataaaatccttctttatcttatccataatagtcgcctacttctctagtttttaaatcaatcgcaaaagcaaacttctcttttccattgctaaaaataatcactacacttaagtccttatctttaaaactatcatcttcaagattgtatgtcccataatcattaccattgacgagttctttacttttaccagtaatctttttaaataccacataattatcattatcttctttatcaccatttttatcttttaaataacggtattctaaagatactgtagggtattctttaatcacatcatcacttgccgcttttagtgtccctaaacgcatcatcgaattagaaatacttgcattttcaattcgatattctttatttgaaccttccaattgttcaactggagtaatttttaaatcaacttcacttaacttttgatcatttgcttctattgttagtgatgctgatttaacatcgtccaaatcaatttctttatatttttttgagatactttgaattgaataaatcaaattatcactatgatattcttctacaacaaattcatagtcaaatttttgttgattctctccatataatgatagtttaactgtaggaacagctccgttagttaaattcacatctttaaaaataattcgtccttctcctaaatgaaaactttgacgatccaaatacgcttcaatattttctacttttaattgattattttcaccttttaatatgtaatcataataaactacttcaccatatgtttgaaatacaaaatcatcatacataaaaaataatgttgctgtaacaataagggtaaagatcaatgtaactagtaaatgctgtttatgttttttgtccatttttatcaccggtcttattataacctattttttatgagatagaaagaaaaacaacccaagccaaatttacatattaattccttattcatcatttttttatgaatttacaacttgctattacttttaaaaaccagataagctcaaaacagttactaaattaaaagggatcgactctgcttttcacaaaatcaatcccttttaaaatcaaatatttaaattataaatacctatttcacaatatacttaaaatctatatgtatttaaaattattttacagtaactaattctaaatagctagtagttccaccaacacctggtgttccagcagtaattaaaatttgttcccctggttcaacaccattttctttagcaagaacttgagcatattctaattgagctgcacgatcatgcataggttgacatacaacaccttttacaccccagtttaaggctaatgaacgagtaactggttcataaggtgtagctgcaattaccatagattctggacgataacgagatacacgtttagcagttgatccactttcagtataaacaacaatagcagataccttaaatttagaagcaatctcagctactgacatacaaattgcttctgaagggtcttctggagcagttctgattgcttttcttaataatgaagcataatctaaagtttcttctgtctttaatgcaatttttgtcattgtcataactgcttcttcaggatatttaccttgagcagactcaccagataacatgattgcatcagtaccatcataaatagcattagcaacgtcacttacttcagcacgagttggtcttggattttcttgcatactatctaacatttgagtagcagtaataacaactttaccagcagcacgacattttttaattaattgtttttgaattaaaggtacatcttcagcaggtacttcaactcctaaatctccacgagcaaccatgataccatcagctacttttaagatttcgtccatgttttcaacaccttcgctgttttcgattttagcgataatttgaatttcaggatgaccattttcaattaataattttttaacatctaaaacatcttgcgcccgtcttacgaaagatgcagcaataaagtttactccttgttcgcatccaaaagtaatatcagctgtatctttaggagataaataatcaaatcctaatttaattcctggaacattgattccacgtttgtttttaactacaccatcgttagcacatacacaaacaatatcttctccttcaacatgatcaactaataattcaacttgaccatcatttactaaaatgaaaccaccaggtttaacatctttatataattctttataagtgattgtaaaacgatcacttgtaccttcaatatcttcagtagtaataacagtagtttgtccttttttgaattctgtttttccacctacgaaatcaccagttctaatttctggtccttttgtatctaataagatagcaatgtttttatttaactctttgcttaacttacgtacagtaacaattcttccaccatgttcttcgaaatcaccatgagagaagtttaatctcataacgttcataccagcaagaattaactttcttaacattttttcgttttcacttgcaggcccaattgtacaaacgacacgagttttcttttttctttcttttagttcaaataccatatcctaattttcctcaccttacatttttatttatattaacgaagcttcattgcatcttcgtaaataccaaaatcagttttacgtttatgtgataatgtttcttcaatatctaatcctttgatttctccattgacttggcttacacataaaccacctttaccagcttctaataattccactgcatatacacccatgcgagaagctaaaacacgatcgcgagctgaaggacgtccccctctttgcatatgccctaaaacgttcgcacgagtttcaaaacctgttgcagcttctacttttttagctaattcgtgaacatcagtaatatgttcagtaataactacgattgcatgttttttatcagattcttttgatgcctttaatctttcaattacttttgattcatcaaaaccaatctcactagtaataatcatttcagccccatcagcaattccagcattaatagctaaatcaccacaacgacgtcccattacttctaagatagtacaacgttgatgagaacttgaagtatctcttaaacgatctaatgcgtcaacaattgtatttaaagctgtatcaaaaccaacagtaaaatcagtatctggaatatcattatcaattgttcctgggataccaatacagttaacacccatttcagtaagttttaaagctccattataacttccgtctccaccaataacgaccaaagcttccatccctacttttttcatttgctcaattgcaacttttctaatttcaggatctttaaattccgggaaacgtgctgatttcaaaatcgttccccctaagttaataatattacgagtactatgacgatcaaatttaatgaaatctccttcatataaccctttgtatcctaggcgtactccgtatacttcaatacctttatttaaacatgttcttgccactgcacgaacagctgcattcattccaggagcatctccaccagatgttaatacaccaatacatttaaccattgtttttcctcctaataaccacatttttatttccaagacattttaacacaaaaagattgatgtttccatcaaatctttaatattttacactaaaactcaaactttttttagcgtaaatccttaccttttaattctactggaatactaaccgctttcattcttgaaattagtcgttcgactctttctttgtctccagcttttaaagtataaagcttttttagtttttccaaagagtattcactagtaaaaaaagtagctctttgattttgtagccgataagcaattattgctgataatatctcatcacgtgaccatgacgtaactgactcaccaccaacatcatcaataaccaaataatctaaatttttcatcagctcaattgaactattgactccctcattaccaaaagaactttttaaatccattagaaaagttggaaaatgtatataaccacatttatatcccttggttacaagacaccgaatcaagaagcccattactgtacttttaccatttccgccttcaccatataaataaaagcctttattagtaggatttttaatataatccatcatcattttaataactactcgtccattgccattaggatcatcaatgattgtcaagtcactcggcttcgttaataatattttattgttaacattttttaataaaatatcattcaaaatcttttgatcatcaaaatgtgcctgaccataacggcaaggctgtaatgaaagctttacttcgccatcctgataattaaatagacgaaccattcctttagaaatcttaggacaagattttaatgatttacagccaatacaaacatctaaatcttctttataatcaagaaattcaatccaattttcttcaatatcacgacgacttaaattaaactcctgcaataccttaataatattatggtcattcattaaagtattaatactattttctttatttttattaaaactatcatcattattaaataaattaatatcttgaatactcttcatcttgccctcctattcgaactgacttaaaaattcatctaactcatccatgtctacattatcattatcaaccatattgatttcagtttcttcattatcatcgttattattacgacgatattttaagtatacattagcttcatccatcgcatctttaactgtcttgattttttttcgtttccactgtgaagctcgtgcttgcataaacgctcttgataaagcattatcacattgggatagtgttaactcaattaacacattcatcacaccaggttctagatacaatgaagtcattatcgattcaacgatttgtaaatcgtgctttaaaggctctcgccccccctgtttatcctttaacagttgataagggttaatactttctaaataactaatatgcttacttaaagcatcatcacctgtaacacttttatgaacaattgcctgcttatgataaatttctttaaatgtttctggcatattcaaatcataataatcacggcatttgctaatcaaagcactgtgaattaatttatcattttgaagacaatctttaactaatccttgcatatcaattgcattaatacgatacaaagttcctaactgtttgattacggcttcatcatcgggagtaatacatgatctttttatttgataatcagcaagcccttgatagaacaatgttaaatcataatcactttcaatactcccataattagtattaaagtaatctttttcaaccaggacatcatcacacccatttagtaaattaatatcgaatacatcagtgaacttagcagttacattattaaatccctcaatactaaacgctgatgatttaaaacataattttgttcgatatagctcctcttgccctagacgttgtaataggagtggtcctagaatagcatgattaaaaaatttagttggtgttaggggtgtttttaaagcatataagtatactcttttattatcactatctttaatatatttagaaactaatcctatcgcttcaagttttaaactcgcttcattaagctcggttaaacttaaaccggttattttagttaaacggctatgaaggctaggggctttagtcaatgataactgatctaattcagcataaagacttaaatataatccacaagcattattaccaatcaaaggttgatatagtagttgaatactacgcatatgaatactatcaagaggataacttgcattaaccgtatataaatcagacatcattaactcgctcatcttatcttcctttcaataatgtttcaatttgttgatataattcatcaagaccctgattattatctaaaacaatatccgctctcattttcttttcttcaatactcatttggttaccaatgatcaaccttgcataatcttcatcaatattatcacgcttcatcaatctttttatttcttcgtcctcttttaaatatacaacaattactgcatcacataaatattccaaattactttcaaataatagcggtatatctaaaaaaattaaatcaagatgctgattaagcacaattatttcttgcattttcttgattacataaggatgaattattgcttccaaatccttttttgcttgtttatcattaaaaataatccgacctaaagctttacgatcaattggtccagctggtaaatcaaagcgattttttgtttgtttaatacacacctcatcaatagttagtgcatcgtaagctaatttatcactatcaaccactagatagcctcgctgttttagataattcgtcaccgtacttttaccagttgcaatactgcctgttattcctaaaaccttcacttacatcatctcccgtactgcctctagtatcttagcacaattgatgctatggtcaagactcattattgtactttcaacctgaccattttctattagatcattaaaatgtacgatttcactataaaaatcatcatgatcatattcaatgtgatatttgaatatttcaccactatttaaaataacttctaaatcaagcggccgatgaattggtcgaattatcattttaccaagcgttcctgtcaatactgcctggttttctttatttcgatccatcgcacattcaacaataccagtttgtttcccaaaatttaaaatagcttttacatatgtatcaacaccacaatcatgatatttacaagtaacatcgacagtatccaaaggtactttaaaataatcatctagataagcaatattataaatacccaaatctaataaacaaccaccctgctttatatcaaacagataagaattctgattataatcaactttaccgcaaaaactagtttcaagacattcaagttcaccaataattccttcactaaccaaactttttgcttcttgataaccaggtacaaaacgagttttcatcgcttccataaataaaatatgatgctttttaactaaatcttttatttcttccatttctgcagtattcattgtagctggcttctcaactaaaactttcttattagcaagaatagcttttttgacccattcaaaatgatataaatgcggtaaggcaatataaaccgcttcaatttcaggatcatccaaaacagcttgaaaactatcataagctttattacatggatgtttttcttgaaaagcttttgccttctctagcgttcgacaactaacggcttctaaattagcacgtgaatcttgagccagagcttcacagaaacgatgagcgatccgaccagctccaactattccccaattaatcattttaccttctccttttttgacaatgcttacagtaataagtcccacgaccttttattgctactttggtaatctcaccaccacaaattggacaaactttttgtaagtgggcttttaatttaacttgaaataaaccatcgatcccattcgctgaaaatgaatgaatcgtagttcctccttgagcaatcgcttcatttaaaattgctgatgacacctcaataagttcctgaacactctttttcgttaatttacatgccggtgtatttggatttaaacccattgcaaaacatatttcatttgcgtaaatattcccaatccccgcaataatactttgatccaaaatagcatgtttaattggtaaattacttttatgtaattttggataaatatcttccaacttggcattaaaaggctctggacccaatttgcaaagggggatttcattcatataattatccagactaactaatttcatacgaccaaatttacgagtatcgttatagcgtaactgcttattatcgtcaagattgaaaatgatatgatcatgtttatttaacggctcatcatgttcaacataatgatactttccttccatacgaagatgtgagacaaatgcaatatcatctaatttaaagattaaaaattttccagcccgatcaatatcattaatagtctgatttgtacaggcttcaataaattcctcaacatcatcttcaataatattaggatataatacatcgattgaaataatttttttattcaaaacaaaattttttaacgttctacgaacagtttcaacttctggtagttctggcataattatctcctatttaagttcataccaattaacggcataacttccttctgcttttaattcaacatccatcttaattgcagtcgtcattcctttagcaacaatttccataacttcttgtaattcttcttgataaacatcaaagatcaattcatcgtgtacttgtaagatcatcttagattttaattggtgtttcttcaatagctcatcaactttgatcattgcaaccttaataatatcagctgccgatccttgtattggtgaattcattgctaatcgttttccaaactcttgacgcatataatttttttcattaatttcacgaataaaacgtttccgattcagcatcgttgtaacataaccatttttcttacaaaaatcaatattactatccatatataattttatctcaggatagttttcaaaataacgcttgataaattcacgcgcttcccctacgcttactccaacttgttctgccaaaccaaaatcagacattccataaataattccaaagtttacagccttagcattacgtcgcatcgtactatcaacttgttcttcaggtactctaaatatttcactagcagtatggcgatgaatatctttatcttcgttaaaagctttgatcaatgatttaacacccgctaaatgagccaagactctaagttcaatttgtgaataatcaaaagatactaaataatcatattccggaacaaaagctttacgaatgagttttccttctggtgttttaacaggtatattttgcaggttaggatcggttgatgataaccttcctgtttgcgtcaacgcctgattatagattgtatgaatcttcccatctataaaaacttgatcttgtaatcctataatatatgtagaatataatttagaaagcgttcgatactttaagactttatcaataatcggatgtatatcttttagtttattcaaaatatctactgatgtagaatatcctgttttcgttttcttaccattgggcaaacctaaatcctcgaataaaacttctcccaactgtttaggtgatgcgatattaaactctctattagcaagcgtatgaatctctttttctaaaatattaatttcacgaccgaattgttcctctagttgttttaaaacaacagaatcaacttttgccccttgaaactccatacgtgctaaaatttttgcaactggcatttcaacatctttatataattcaaattgattttcattattcaatttttcaattgcctgatcctttaaaatataaatagcttttgcctgtttaattaaatgctctgctactcttgatgtttcaggaaccttcttctttgcaccctttccatatacttcttcatcataaaaaacatcgtaatactcataatactcacaaacactgcgaatctcatcttttaaacttggattcaatatataagaagctaattgaagatcaaaaacataattttctatttcaaggccatgccattttgctgcattaatactctttttaatatcataaccatatttttcaattttcttatcactaataaaatttttaaaattagtacaatttaaggcatcctcagtcccaatgaaataagcttcactatcgttataaactgcaaatccaacgatcattgaccgatgataatttgtatcatacacacctacaaccaatgaactatcacgcttaataattggtaattgagttacgattttaacatcgactgctttttcagcctgaacctcctcattattcaaagacattctttttaataatgaattcatgctgtaacgtcggtagaattcagctaactcattataatcatgtccttgataacgatattcttctaaatcaatttccatcggcacatctttaataattgttgcaattcgctttgataacaatccctgatcaatattatcacgaattttttcacccatctttccttttaaatcatcaagatgttcgcttaaattctcaactgtatgatattcctttagtaattttaaagctgttttttctccaactccgggaatccctggaatattatcagatttatcacccatcaatccttttaaatcgcgcatttgatcaggaatcaaaccatatatttctttaaatttagcaggggtgattttttctaattctcctacccccttcttagtaagataaacactaatattatcatcaactaattggagcatgtctttatcacttgtaacaatacttactttaaaacgttgtttgcttgctttaacagcaacagttccaataatatcatcgccttcatacccttcgatttcctgataacgaattccatgagctgttaaatattcacgaatcattgaaaactgacaagctaattcatcaggagtggcgctacgagttcctttataaacttcaaataaatcatttctaaaagtttttttaccgtaatcaaaggcaacaactaaatactcaggattaccctttaaaatactttctaacatattggcaaatccatacactgcattagtaggaacaccatctttatttaccattaaatttcccattgctgccgttgcataataagcacggtacaacaacgagtttccatcaatcattactaattctttcatttctaccttccttaacgtacattttttgcttgatttattattagtgatagtttatcacgataattaactctaccttcaattaaacaaatctcaccacgtactaatattttctttaaaacttgaaaacttgaagcaaagacaacagcatctacttcaccagtttcatcgtaaccatcaacaaagcacatctcttgtccttttttatcaacaatcacttttactctcgataatgccataataactctaaccggctgatcaatataattggataattcatttaaattaactatttgctcctttaagttattcttgatcaaagcaatcggatgcattgtcaaatatactccaaggaccatcttttcttcttccaatactttgatccgattatcacgaacgatcgttaggatcggtggttcatcgattccaattgaatttttcaattctgcatattccataatcttatgtaaattttgtttaattgtcgtgcgatttaatttaaactcatcaaaagctcctgccataattaaactatcaagcattttactatttaatttgcttgattccattctagaaacaaaatcaaatatatctttaaaagtaccattttgacgctctgcttcaattgctttatatcctgcataaccaacatttttaatcgctaataaagaataacgaatattgccatcttcaactttaaagcgatcagttgaataattgattgatggtgccaatagtttaacaccatatttttttccctcttggatacaactaagtttacttgcatcactactttgttcatttgataataaagcactaaaaaattctaatggaaagttcgcctttaaatatgctaaccaataggcaatatatccatagacaaccgaatgtgatttattaaaaccatagttagcaaacctttcaatcaattcaaacactttaactgcttcgagctcactaaacccattagcaattcccccttgaataaattcactcttcatcgctttcattaaactcgctgtcttttttgacattgcttttctcaaaatatccgctttagctaatgaaaatccagcaactaattgtgccgcctgcataatttgttcttggtataaaagaattccatatgtagattttaaaattggctttaaacattctaatggataagttattggttctttgcctttttttcgagcgatatatgaaggaatattagccatcggtcctggtctaaataatgcgattgcagcaataacatcatcaagacaatcacattgcatcttaactaataaatttttcattcctgaggactctaattgaaagattccaaaagtatcaccacgactgatcatttcataagtttttttatcctgaagatcaatgtcgttaatattaatttcaacttgatgattcttagcaatatctttaataatataatcaatgatcgttaaattctttaaacctaaaaagtccattttgagcaagccgacttcttcgatataatcttttgaatattgagttacaactccattgttaggacctctgacaagcgggacaacttggtccaatacgtcatttgataaaaccactcccgctgcatgcgttgaaatattacgtggcaatttttcaacaataaaaacagcaggcatgatctttcttaatgcaggatctttattcaccattgattgaaaactatatgatgtttcaaaaacttctcgagcactcttacgattcttataattagtaggaatatttttagttaacaattctaatcgtggcaagggtacccctagtacttttccaagatctttaattgctactttaggaccataagtagaaaaagtaacgatttgcgctacatgctcatgaccatatttttcagtaacgtaatttacaacttcatcacgacggtcatcttgaaaatcaatatcaatatcaggcatactaattctttcttcatttaaaaaacgttcaaatagtaagtcatatcgcaatggatctactccagtaattcccaatacataagccactaggctgccagccgctgaaccacgtcctgggccaactaagatcttatgcattttagcatatcgaacataatcaaaaacaattaaaaaatagtcattaaatcccatcttattgattactgttaattctttttttaagcgttcaatatattcattaggaatgttttttcctttaaatcgttttttcaaaccaactaaacataattgccttaagtaatcaccagcatcgccatctttaggaactgggtatttaggtaaatgcatttgatctgttggaatggttacattacacagtcgtattatatcgttagtattttcaatatattttttatcaaaaagactctccatttcaaaactagattttaaatataattgatcagtttgaacttggtgttctaaatctaacatcattcctttagcggaagcttgtaaaagatctaaagtaaaagcctcatctttatttaaataacggacctcattggttacacaaatgggaatattttggagagttgctaaagcgactaaacgttcatttaatttttgttgcattgcaataccatggttttgtaatcctacataaaaattattaaaagtgtttttaaacagttctaaatactttaacgcctccgaatccagttcctttaggataagtcgttcaataattccttctttacatgctgaaattacaaatagatgttcacgatataatgacagtgcctctaaactaatcgcacctctttcactcaaacaaatttcactagttattttaaccaaatcaaaataacccgtcacgtcccttgccaatagtaataacggatatatctcatgattgatttcaacacttgcttctaacccaaagactgctttaataccgtattttttagcatatttagctagttccattgccccatacatgttatctttatcagttaaagctagcgcctcatagtggagatcactagctttttttaccaagtcctcaattaagatagtactattttgaaaactatatgaactataaacttgtaaatgtcctagcatctatccccacatcctttctattgtgtattataccactaaataagctatttaaaaagatattagaggattgcacggaacgaaaaaagaataatcataatagaaaaatataaacataaacacatataaacggtatcaaagattgcccatgaagtacaacttaagagccaaatacgataacaatataaaattgtaacataataatgatattgtacttgcaagacacaaaagcgtctttgccagccaatgatcactatcgataacaatgttgcaattaaatgaaacgggacgatccacattggacacagtacctgcatcaataaaattgccccacataaaaattgtaactttttaatccgtattaacatataatcaccactaatattatatgttatttactctaataaaatgaaaagaagtggataatcaaatgattattccactacatcgcatgtttaactaatgctttagctaattgatcaggacaactagttggtcttgccccacaacgaataccttgtaatcgttcgattacctcatttacttgcatcccttttgctaatgccccaacaccttgtgtattaccagaacatccaccaataaattttacgttattaacaatgccatcctcaacgtcaataactatttgttttgagcataccccttgaggttgaaatttaatttccataacaattcctcctatttttaaatattatagttacaaatgaaaataaagcaaataatttgctttattttcgaaccaattttacaatcgttgttaggtatgaattatgacaagatgtatctaagccaataattctttccaatttgtaatttttttctaaatcagctaaatcctttgctaaagttgaatgtgactgacaagcatagataattgttttaaatttagcaattttaattgtatctttgattgtatcacttaatccataacgttcattttgaataattaaagtatcatagactttctttttagcgtatgtaacaattttactatctaggtcaccagcaataaaagtaacattttccttctttaaatacttagcatttaatttagcatcatcaatttgatatcttttttcatcaatcgctacaatttcttgatcaagattaagttctaataacccaattccacaattcaacgaaattattttttgactgtcctgtactaatgatttaattgtttgattttgtttccacatcatctcaatattttctggtaatttacttttaaccgatactagatattgatttttatcatcgtgcaactctagtctcgttgccccatataattttgaatatcctaactcatcaaactcttgatgctttgaagtattaacagacatgaagatactagcaacatgtggcaattgactaatttctttaacaatttcttccttcaacccatcacgacctgtaataaaaactaattgtaatttattatcaattaatttaacctttaaaaaccttaatcctgttctaaatttatcactatatgttttacatttatttgtagttaaaatctcttctaattttaataaacactcattaattattggatgttgtttaaaacatcttgtcattaatgttaaatatttactatcacgttgatagattccaaaactaattttccctttaaaatcaacaataggcaaattaacagcagtaataaagccctcttgactaggcgccgcaattacatctttaaaaattgttcttgataaatcatactctgtatattttctaattgattcgcgtacagcttctttttttgcattcaactgcttgaaataacttaaatgcaacatcgtacacccttgacaattatcatacgaacgacacttaggcgtaacacgatcttttgatggttttactacttgtagtaatttcccttcgctataagttctagtctgtttaataatttcaacaataacttcttcttgtggcaacgctccaggaacaaaaacgatctttcgatcaatatacccgataccttcaccattaatccctaattttttaatttctacatttttcttcatcctacaatctcctttttaaaagaggaagtcatctagtgatgctcttcctcttcatctttcttttcttctagaatcgtcacttttaattgagcaattctgtttttatgcatttttacaatcttaaaaattacgttttcaatctgaacttcatcatcaatttcaggaacaccagatacctctccaagaactaatccaccaattgattcaaaatcttcagaatcgaaatcagttcctactctatcattaacttcatttaaattcaagcttccatctattaaatattcattttctcctagagaaatgatcatttcgtcttcttcagcatcatattcatcatcgatttcgcctacaatttcttcaacaatatcttcaaaagtaacaattccactcataaccccatattcatctagtacaatcgctaatgttgcatgttctttacgcatcgaagcaaacacatccgcaacttcattaaattcataaacaacaaaagtatcgcgcataaaatcttttacaacaaattcatcaggatcaatattaaagaaaagtaaatccttaacatttaaaactcccacaatttcgtcaaatgattcactatgcactgggtaacgtgaaaattgactacgttgataaatttccatcaattcttggtaagaacaatcatcgggaatactctcaacatgaattcttggcgtcataatttctttgatctcagtttcaccaaactcaaatacattatgaatcatttccttttcctgttcttctaataccccctcttcatgacctactgtaacgatcgtctttaaatcttcttctgtcatggttggtccactgtcacgagcgccacccaatattttaatgaaaaagcttgtaatgatatttaagaaaaataccactggggtaaaaagagtacaaactaaagcaacaaatcgtgccaaaaataaagctattgtatctgcattcttagttgcaaaagattttggtgtaatttcaccaaaaaccaaaatcaagaatgtaactactccagtagctgcagctactagagttgctgaatctccaaaaattgaaatcacaaatgatgtagataacgatgaagcaccgatattaactaagttatttcctactaagattgaactaaataaacgatccgaattagataacagcttctctactgttagtgctcttttatttccttcttcagctaagtttcgcatcctgattttattaacagataaaaatgctgtttcagtacaagaaaaaatacctgagaaaataattaaaatgacaaatattataacattggttatctgggtcgggtccacaataaatctattctccttattattaatgtttttcattatcatattataaacattataaaaagtcaaattaagctttaattaaccaagcataataacgattgttgatccggcttcaactgactcaccaactcgtggtaattggtctattactttatcaccttcgccaataaattcaaattttaattccggattactaacttcctttttacttttcccaatatagttttcaacctttaacgttttagtatccataaatgtataagctttttgccgctgtgaagaaactttttttacattcatgcttggcaaaatatcaacaagcattttgcgagcaattggagctactgtcgttcctccatactgcacacaatttttagggttatccattgcaacatataaaacaattttaggatcatcaattggcgcaataccaatgaaagataagatataacccccatcaacataactaccatttactgctttttgggcagtacctgttttaccaccgatccggtaaccatctatataggcatttttaccccctccatctgtaacaactgattctaaagcatctcgcatttttttggaagcatcctcactaataactttacgtagtgcctctggtttatgttcataaacaatatcattagaataactatcaataattttatcaaccaaatatggtttatataaagttccaccgttaacacaagcacaaactgctctcaccagctgcataggtgtaattgaaataccttgaccaaaagcaactgttgcttgttccaactcattgaaggcatcataatcaaacataattcctttagattcacctggtaggtctataccggttttttctgtcaaaccaaattttttgacgtattcatataatttatctttccctagacggcgaccgatttcaacaaatccggggttggaagaattctgaagaacctctctaaaggtttgaagtccatgtccaccttttttccatgacttaattcgggcaccaccaacaatttcataccctttatcaaaataagtatctttatccatatcaaatagattttcatttaaagccgatgaaaaagtaatgatcttgaaagttgatcctggttcgtaagatttccaaattgggatattatgattataaacatccttatcggcattttgataatcattgggattataatcaggtttacttgccatcgctaaaacttttccagtacttggttccatcgctaaagcccagattccatcaggattataagtgtcatatgcattgttcagttctctttcaacaatatcctgaatatcaccatcaatcgttaattgtaaattaaagccactcgttggagcactataaacacttggatacagtgacaacgggttacttttggcatccatataataatcaatactcccgttatttccgtttaaataattatcgtattttaattctaaacctaataatccttgattatcaattcctacgaagccaagagtctgtcctaaataattatcattgggataatatcgtttagtatctttaattaaatataccccaggtaattttaaacgatcgatttgtgctgctacttcatcatctaattgtcgtccttctggctgaattctttggattgaaacttttttacttaatttttcttgcattactttaacatcaacatttaaaatatttgcaattttatcagcagtagccgccacatctttaatttgactaggaacaacaactagtgaagcagttgttagatttgttgctaaaacgttattatcactatcaacgatcaatccacgattagcttcaactggaaaactacgctgccataaatccactgctttattataaatattgactcgatcaataatttgaatatagccaacttttaaaattattgcaattacaatcaaaactgttactacttttacccatttgattttcttttttgttatctcatagatcatctaatcaccctctacactatatgaaaaaagtaaggtcattagaccttactgaagtgtaattgttagagcatcaccgttgtgaacaacagttccctctggcgcactttgagctccgacgagaccgttaccgccatcaatagtaatattaacccctgataacgagccaaaagttaaaacatctttacgtgaccagccagtaaaattaggtaatacaatatcattagattccgtcttaataaaaacacgatcattttttgctactttagaaccagcttctggatattgttcaagaactgtattaccgtttccgattacttgaacatttacagcttttgattctaattttgacttaacaaaactaacactctgattaacatatgaatctagtttataatcactagatactgtcgtagtttcaggagcattatatttatttacgattgataatgctgccggcattacacttttaataacatttgcctgatgttgagttgtatcattatcagcaccttggaaaacaatattaacaattatttgcggatcttcatatggtgccattcccgaaaaggatttggtataaatagtacttgaataaccaccatcaacaactacttgtcccgttccggtcttaccgataatttgaacaccattatcaagattaaatttctttgctgttcccatactttcagttactactccttttagtagatctcgaacatgttgaactgtttgtgaagaaaatatttgttctgaatattctgttttacctttatatgtaacttcgtttgtttctttattaacgattttttcaattaaataaggttcaacagtttttccatcatttgcaaagacactatatgcgcgcaatagttgtaaagctgtaacggtagagccctgcccaaatcctgtagttaaataggccgctctacttttatcggttttgtataacgctgtccctgcaactgaatcaaagccatcaatattgcttgattggaaaaaacctaatttttcatatacatctagtaattcatcacgattagtatacccgcgttcaagcagattgcaaattgcaacgttacttgaacgataaaaaccttcatcataactaatactcccccatccagcaccattattatggtcgcgaatcggtcttgaaccaccataatcatatttaccagattcatatgtagctgcaccattatataagccgctttcaatcgaactagcataaacaaatgatttaaaaaccgaaccacattcataagcagtatcaaaaaagaaatttttatagtcctctatatttcgctcatttggattaaatgaaggataacttgataaagctaaaatttttccagtcttagcctccatgattacacatgatgctttaagagcttgtgccgccgctgcttcagttgccagctggtaatcaagatctcgttgtaatgaactgtcgatcgttaaataaatgtcatctccatcaacagcgtctttttgttccaagattccgtccggtaaaacatatccttttgaatctttttgatagactttataaccgttttcaccggataaagttttgtcataaattgcttcaagacccatttcaccgacaagtcctttgactccatccgtttcagttcctttagcataaccgataatatagctgcaaaaatctccatatgggtaattacgagaattactttcaataaattctaaacctggtaatccagtatcctcaatttgttttttgacacccgcacttagatcattaccattggttccaaattcaacctgatatgctcctgcatctaccttttcttggagtttttgagccattacagttgggtccatcccaataattggtgctattgcatttgctgtagccgtaatatctttaacatatgcatcatctttgccatgattaattctactacttgatacaatagcgattaatttatatttttttacatttgaagctacaacttcattatcactagtataaatttcccctcgggttgcataatcaatcgtttttgccttacctctacttttagcaaatgtggcgatatcagccccactgattaaatgcttacctgtcactcctaaataaacaatattagcaacaagggaaaaaataactaatgcaaagacaacataagctatctttgcacttttaaattgattcattattgattttgttgtgcttgagtagaggcagctactgaatcattgctatatgtatatcctttagcattagctactgaactaaggcgtgaaaaagatgctaattcttgtttttgcatttctaaactatcaatatcactctttatcgttttaatttccttttctagaacttgagctgttcggttatatgatgattccatcgacttaacgccaataattccaaaaacaaaaattaccattgaaattactagaaatctttgtgaaaaagcttcaaatttagtttttttagtcttatgtctcattttcaaactccctctcgattattcttagttttgcagaatgcgcgcgatgattaacttcaagctcttcttttgaagcaaccattgcttttttattaattaatttaaatctcggctgtaagtaatcaggaattactggtaatcccggtggcacatcctttaacttagttacatcattaaatgtatatttacatattttatcttccaaactatggaaagtaataactgaaattctacccccaacgttcaataaatctagtgaatcctttaaggctcgatcaaagacatttaattcatcattaactgctattctaagggcctgaaaagtccgcttagcaggatgacctcctttacgtcgggcaaaagcaggaattgcatctttaataatatcaactaattcaaaagttgtttcaattggtcgtatttgtcgtttttgttcaattttacgtgcaatctgtttagcaaacttttcatcagcatatttatataaaatttcaacaatcctttcatacggccacgtattaacgattgcataagcatcaagtggatttgatgtatccattcgcatatcaaggcgagcatcataattatagctaaagcctctagaacctgtatcgaactgaggagatgatacacctaaatcaaacaatattccgtcgactcttgttacacctaattcatttaatttttctttaatatttacaaaattagaataaatgattgtatagttgttaccaactgcatcaaggcgtagacgagctgcttcaattgccgtttgatcttgatcaaaacaatacaaatgaccggtcgtaagctgctttaaaatagcacaactatgtcctgctccgcctaaggtgcaatcaacataaattccatctgctttaatattcaagccctcaacggcttccttcaataatactgttacatgatcaaacatcgctctctcctataattcaaaaccttctaacgattcagaaatttcatcaaagttatctttattggcatcataataatcatcccaaatattctgattccagatttctacatgatcaccaacgccaacgatgatacattccttttctaatttaccttctattcttaaaacattaggaatatttactctccctaatttatcaaattcacattcacttgctcttgaagtaataattctaacaaagttacgtgcctctcttttagtttttggcagtgtttggagtttttgataatagtcattccagccttcttgggtgtataaagctagacaaccatcaaaaccgcgagtgattacaacactctcgccacattgctcccttaattttgaaggaataataagacgccccttggcgtcaatattatgcctaaattcacccatgaacatctatatcacccactctttaacacttagtaacacaaattaacacttcttaccaccattatataccctggtcgatactttgtatagcattttctttaaataagaagatttcgacaattaaacaaaaaagggtcaattaacgtaaaatttcgttaatcaacccttaaacaacaaaaaaagcgcccttaagacgccgtttcttataaaactttttgtcctttgtaagtaccgcaatgtttacaaactttatgagacattttgtattcaccgcactctggacatacaactacagctggtgctgtaagcttatcatgagttcttctcttatttcttcttgtacttgaaactcttctaaatggtactgccatcagtataacctcctatttaatctttaaaataatcttttaatttagctaacctaggatcgatataatcatcatctttatcactagtactgttatctaatattctccaaccttttcctttagatttaatattagcatcatctttgacgaccctcatcggtacttccagcataatgttttcaaataccactggggtaagatcaacaatatctttttttacttcatgaacatcttcaagtggatcaggtttttcaaaagcaaacacttcagttgaattaatttcaaaaggatactcaacatcttcaagtgtaatagcacaaggaagaatcatagttcctttaatattaagatcaacatataaacgtttatctttcaaatcaagatctccggttcctgagacaataatgtccttcaagtcattaatttgagcatactggtcaaataactccgaaggaaaagttagtccctcttcaaaatcaaattttccacgatgcttaacaatccattgtaaattgtatttcaaaataatcacccttctataaccgcaatgacaattatatataaaataataccataagtcaacctaaaaaatacttgtttttatcgtttattttactatattgtcttagaccatcttgtcgatatctttaggaattttatttgatttaatcatcgaaactaatttatcaaccttgctaggagtgattggtttattagtcaccttagccacactcataataaaatccttaatatcattttcattatttaaatctttagactgtaaatcattagctaattttaatatttctcctttattaacattagttttctttacaaccttatctaataaaacatcttcatctttcatattatcaccactatatactatgataatatttaaataacgttacccctcaattttcaattctcgacgcatcagctgttgaatctcacgttttggttcatgattattgtatagaacattgtaaatcgcatttataataggtaattcaatatctgtatatttcttagcatcttcataaataactcgacaagtacgaattccttcacaagtttttttattatttttcatgaaagcacgtgcatcattggttttaccaatttctagaccagcctgaaaattccgcgaatggaccgatgaacaagtgacaattaaatctccaacacctgttaatcccatataggtttctaatttaccaccttttttcgttccataacgaaccatttctgccagaccccgagtaattaatgctgccttagtattatcaccatagcctaaaccacttaaaactccagccgccactgcaataacatttttaatagcaaccccgtactcagccccaacttcatcatttaatcgatagactctaaaataatcattcgaaaataacgtctgaacatctcgggcagtatcatcatctaacgaaacagcacacactgtcgttaacattcgaacgactacttcttcagcatgacttggaccaatcaatgaaacgaccggattaatcaagttctcatcaagcacactacgaatcgtatcagacatacgcatatttgtccctaaatcaaaacccttagctgcatttataactgtaatctttttctttattaatggttttacttgttctaatgtttctttaacaaattgtgttggaatagtaattaataaataatccatatccattaaggcttcttctaaattatttgtcgctttaatttcactttctaaagaaatattgtgaaaaaaagcttcgttttgatgattaaaattaatatcatcaatttgttcttgatcaataccatacatcattatctcattttgattatcgatcaaaactctgcttaaagctgttgcccaacttccagttcctagtaccgcaattttactcattgttacacttccttatattattgtatcaatattataccaaactaattaattaatagcacgactaatcacgtttacgacaaataatatgaattggcgttccttcaaaaccaaaagaatctcttaaacgattttctaaataacgcttataactaaaatgcatgtattgaggatcattaacaaatagaacaaaagttgggggacaaatactaacctgattagcatagaagatttttaagcgtccaccattgaacgtagttgttggattgattgcttgagcatcaacaagaacatcatttaaaacactagtttgaacacgtttatgtgaattttcaaatgactcttgaatcaatgggaataattgttgaactcgttgatgagttttggcagataagaaaataatccgcgcataatccaaatatttaaactgactacgcaattctttttctttcttttgcattgtcttctcatctttttcaactaaatcccatttgttaacaactaaaattactcccttaccagcttcatgagcataaccggcaacatgtttatcttgttcaataactccctgattcccatcaataacaacaacgataacatcacttttttcaattgatgataaggctctcaaaattgaatatttttcaatattttcatataccttacctttttttcgcattccggcagtatcaataacacgatatttttgtccatccttaacaaatgctgtatcaatcgcatcacgagttgtcccttcaatattcgaaacaattactctttcttcaccaagaatcgcattcgtcaacgatgattttccgacatttggtcgtccaataattgagaaacgaatttcatcttcatcaaattcttcttcaacaaaatcgagattcttaatgatttcatctaataagtcaccaattccaattccatgacttcctgatactgcaattgggtcaccaattcctaaattatagaattcataaatatcatctttaaaagcattatcatcaattttgttaacagccaataaaaccggcttacttgttttttgtaaaagacgtgctacatactcatcttcacgagttattccttcacgtccattaacaacaaaaacaattaaatctgcttcttcaatggcaatttctgcctgcatcttgatttgggcagtaaaagatgcatcttgtaattcaattcctcccgtatcaatcaaacggaattcttttgtcaaccatgttgcagttgcataaatacgatcacgagtaacacccgcaacatcttctacaatggaaatacgctctccaacaattcggttaaaaatagttgatttaccaacattcgctcgtccaactattgctactacacctgccatattatacctcctttattttttcttctactaattttaaaacagcatcaacaacttcttgtaaagtcatcgctgatgtatctaatacgatggcatcttctgcctgttttaacggtgaaatatcgcgattcatatcttgataatcacgttgttcaatatcttttttgatcagctctaaatctgctgttaatcctcgctcttgattttctaaataacgacgtttagcacgggtatcaacactagcaatttgatatattttcaattctgcatttggcaaaacaactgtcccaatatcacgcccatctaaaatcacaccaccaacatttgccatctgacgctgctgttctacaagaaacgtacgaaccgcctgataacttgatactacactagcagacatagaaacttgatcttgacggatcacttggctaacatcttgcccatttaaaaagatatggttattactatccatttcaattttgatttgtttcaaagcctgagataccgcttgttcatcttttaaatcaatattattttcaagacaataatatcctacacaacgatacattgcccctgtatcaatatagatataatctaatcgtttagcaactatttttgcaatactgcttttaccagccgcacttggcccgtcaacggcaatagaaatttttttcataatatcctccactccttgaaaaaaactaagggtaaccttagtttaaaagaacaactggtatcctatcataccacacaatccaataaatacaactactaggaatataattacatagtttaagatagtagcgattcgatcacttttcttttcatcaacaatatcactacgagattgttttgcctttgatttactatctatagttttatcatttgtttgatttttaatcacttttaaatctgctgtgtcttctttttgtttaagtactttttcaacctctcgctgatctttctctttaatctgtcgaagcatttcctctaacgaacgtgtttgttcaatttttgccaattcttcatcttctaaagtgtcctcagctgttccagaactcacaacacctgtatcttttttcaatgcttcttcaagttcattttctttttgctctgcttcttcctgaacttcgtccattaccagcttagcttttttagcatcttcttctggtgacatgctggcaagtcgttccattaaagtcatcttctttttagcagcctttttttcttcttcagcttttgtaacaaccgattcctcctgatttacaaaataccctttagaaaattctgaagtattgatattatccagattatcgatatgaactacttgcttttctggttctctaattttatttaaaatatccattcttgtattgtactgcgcttctttaccaacactgaccttagcacttcgcaaagctcggtttatttcttcactgctttcttgacgcatttgttcaaaagttttagcttctgtcaaagtgtcattaatatctggcaagtctttttcttcttgtttaaaagaacgatttattgtcgctaaaaaatcatcatcttcaatatcatcaatgatatcaattgtatcctctatattttcacgattaatccctgcttcatcttttaaaccagctcgtaaatcgcgatatttgtttacacgtgaactattcactcgaaatcaccctttcgtcgtacattataacatactttttcattatttcctttataaaatattggaaaatatatttatttgggatataatagatacataacaaaggaggaatttataatggctaaaattacagtaaacgaatcttgcatcggatgtggtgcttgtacaggtgttgcaccagatgtttttgaaatgaatgatgaaggattagcatctgttgttggcgatgatgttgcttcagctaaagaagctgctgagtcttgtcctgtagaagcaatcgaagtagaagattaatcgatagaaagaggctgtaacgaataaaggtttttaaacctttaagcgttatgccttttttattttttgagtttttagaataataaaattattcgtatgtgtatgactttttgagtattataaaaaatatcgctcttctgtttttaaaattttgatatttaagaaactatgctgtttctattcttatgctttttattatgatattttcttaaatttatatactattccgatcagaaaaagctctgttttcacatctagacttcctttttttctcagtcttgtataattcatctcctatttaataactccaaatgtgtcttcagcctgaatgcttctttgctttttcatttctatcccatcagctgttctcaagttttcatctacttttgactgaagtttattaagattgtaattaatttgtatttttctttatttaagcattcattgcaatgtctatattcaaacactctgcttatctgtaagtaatcacctctggtgttccatacttcttcctattcaatattaaatgtgtacccttgaggaaagactttataacctgaagaatcatattggggttggagcctttatcgcctctgtgagagcagtcaaaatacttggaggtattaatacctttcataatctctacgaatgatgtcaacggatcatctataggtataacaataaaaaagtctagtggaagtctgcattgaaatgtgtcataattaccattggctatagggtaattagattctaacagttcgatgtttttcataatctaattataccaaaaacagcacttaaactctatttgagtctaagtgctgtttaattttttagacaaacacattattttaatgcgtcacagcctccttgtttttccatttatccatgtttttcataataattgtttattacgaaaaatattacaaacatcaccacaaccacactcacaagtgtggttccagctatcataaacatcattttctttgtgattccatacaaaacaattgtaataatactacctgcataaagtaataaattcattaattgtactgttttttgaccactcttcatcgcaataaacaaatctcgttcatctgtattatttttcaattcatcttcccaatcattatcaaaacaatgatataaattataaacccctaaaacaaaagcaactagcaaagctaatccatattttaaaacaaagcccttttgccaaataacataggctgtagcaaatactaaaataattcccaatgtcccattaataatataccggggattgatcttatgcatttttttgatcctccaattctttattttcttttaaacaacataattcctcaattgtagtatcgaaaacttcggcaattcgatacgctaacattagtgatgggttatattgttctttttctatcgaaatgattgtcctagatgatacatgaaccagatcggctaactgttgttgtgtcatattttttattaagcgcatttcttttattcttgttttcatttccaccaccataatatgaagttaacttcacgtgaagtacatttcatattataaactaaaaaaatagatatagcaagagctatatctacagtgatttcaataacattaatgctgttgctttattagatgctaaaggaatatagtgtacatcacataaacgtattaacgcgctaatatctggttcatgcggctgtgctgtcaaaggatcccgaaaaaaaataaccatatccatctgtcctagcgcaattaaatttcctacctgttgatctccgccataaggtcctgataaaaatctagttacttctaaatttgtattctccatgacctttttaccagtcgttccagttccatataaattatgtcttgcaaaaatttcttcattatctttaacaaaatcaatcaattcgccctttttctgatcatgagcaattaaagcaatattcatcttatgcctccttaaactttgattcaattggtcttactatataatatacaatagcagaaataatccctttgataaagttaaatgggaaataaatgataaaaatggcttgaccataaggcgataagaaattcaaaaagcccggtacggacatatttgtaccatattgttgattgaatgaattaatatctaaaacaaatggtaaatctgtataccaagttggtttttgagttaaataagttggagttacaaacaggtaattcaaaataaacattaccattgcaaatacaaacattgtaataatcatgttcacggcataagactgccattctttttgtaattttaaatgtcttgataaataataataaacacaacaaatcgtcaatgaagcaatcaaagcagtaatctgaccaattgcaattggtcctaccggtcccttaaataaaattgaaacaaagaatttacatacacacacaaataatgctgatttaaaccccagcattgaaattgccataattacaacaatttctgataaatcaagatttagccaaggggctaagggatatggtatctccaacaaacccaagatcatccctaatgccgccaacgctgctgataatactaattttcttgtcttagtagtttccacaataatttctcctttataataaaaaatatcatgaaaatactaatctccatgacaaaaaggcattaattattaactaaaaaatgtcattcttccatccagactatactgtcggtgtaggaatttcacctactcagcttatgctcgcggactttaccgccggtcgggaatcacaccctgccctgaagactttcttttcctatataatatagcatagtattcctactatttcaataagaaaaaactaacagttagttattctgtcagttttgttgtttttttgtattattataaactaaaaagattcctgcaaccaatccaatagcagccaagagcaataaatatgctccgatagaaatattcccataaccacccagtactgatttagcattaaaaatttcatataccgccaaaactgcagttgcaccagctaagcctaacgctacaatgtctttatgaagataggataaaatcaatgcaacaacaactaaagcaatgcaaataataccatctccaccatccattaaactaacactttgactatatccaaaaatcgatactgaagcaaatggtaaaaagcatgaaattattgccaagatacccgacccaaacgtaagtacctcgagcatgttgaattttttccctgaaatttcaacttcttttttctgcatattttccccaaaatcattaattgcactttttgttttatcaacagactcttttaccggtattccagtatcttgacttacacaatcctcaccgcaattaggacaaaatttcacccctatttctaattcctgaccacattttttacatttcataattttccctcatttcatttttaagttacctttccctaattataacttataattacattatattataaatctccattttccacaaataaaaaacaccagctctttattagctggtgtcagttattcttactgttcacccaatgtcacttctattgttttttcagtaccattacggttaaccacaacagaaactttatccccaggttcttttgaatataattcagttaagaaactcttataagtagttacttctttaccgtcaaacttaacaataatatctccttcttgaatacccgccttactagctgctcctccagaagtaactcgagatacataaataccatctgtcaaatcagtattaatgcgataatagcgtaattgatagcttgaataccctgataaagatactcctgagataccaatttgtggacgtgtcactttaccattttcaataatttgttcaactgaagtaataacatcattgattggtaaagcaaatcccattccttctactgaagtattagataatttcattgaagtaatcccgactaattcaccagccatatttaccaaagcaccaccactgttaccagggttgattgctgcatcagtttgaataacattcatatcccaatcttcttgaccatcatcatttaaatccactgaaacagtacgatcaattccacttacaattccttgagtaactgtccctgcgtattcaattccaagcggactaccaatcgctaatacagtttctccctgatccaataaactagaatctccacatttaatagcggtcatatcaaaatcagcagttaattttagtactgcaatgtcactgtaagtatcactaccaacaatcgttgcatttacagattctttatttgaaaatactacttgcacatcagtagctccacttactacatgggcattcgtaataatatatgctgtttttccatcaacacgataaacaactccactaccgctaccactagcagttccattagcatagactaatactccaacaacactactattcactttttcaatcacatcagttgtagagctcttcacatcataatttacattttccacagttgcattcttattcgatgaagaaccacttgacgagctcttattaacttttgtaaataagaaaacattcattcctaaagaggcaaccactaaaagagtaataactatcttaaataaaccatttgtatttacagtcacttttcttttattatgttttcccattcttgattcaggttggttactattttcttctttttctacttgttcttccattggatttctctcttccatttataccactccttttactttacacacatatcttaaataaataatttgttcaaattatttttatattgtgtgaaaaattgtgttacttgtaaaagaaattatattttctacaaaattggcaaagttaccgtgaaagtagtcccaattccaggagtgctttctacatcaatggtcccattatttaattccaccatttttttaacaatactcaatcctaaaccggtcccaagtttcttacttctagaacggtccacttgaaaaaagcgatcaaagataaacgggatattatctttagaaatgcctaccccttcatcctgaacaacaattattaaattatcatctttataattacatttaattgaaataaccccagcattagaatatttaatagcattagaaaccaggttatttaaaatcgttttaacggtcgtataatctaacatcaattcttctttgatttttgtttgatatactaatgacaattgtttatcttttgctaaaggctcaaataattccactgtatctttgatcagtgaatcaatatctaccagtgcaggacttagagtcgcttgaggctgttctaatcgagataattctaaaatatctccaataatattctgcatccgataactttcctttagtagtatacccataaattcgttaaaagtatctttattttttattccttctttttgaagaatttctacgctaccaataattgcactcattggtgtttttaattcatgagaaatatctgaaaaaaactgtttttgcatcttttcgatctcttttacctgtgtaacatcagtaaaaagaataatacttccatcgaatgctacatcatcacgaaatacaggtgttgtttcaatttgataataacgttcatcaatacaaactgcagttgaaaactttctttcaaaaatataactttgatcaacaatatttaataactgatctgtaaaaatatctttataatatttacctcgcaaatgtttgattttaaaagcatcacggaaactctgattagtgaagataatcgttccttctttattaacaaaaatcatcggtaaattcattgttttgattagagaatttaagattttatgattaaaatctttttctccttcaacttcacgaatttcattttctttttcacgtttataaaaattaatttgctgttgataataacgatttgtatcataaacgataaataacatcgcaatcataaatccaatcaaataaatataactataattaaaattccaaatcattaaaataattacaatgattgctgaaaaaataaccttttgataattcttattcatctttgctcaccaacttgtatccaacgccacgcactgactggaaacaagcctgactatcttttaattttgtttttaatttaaatacatgaatatccactaaacgagtatcaccatcataattaaaattccaaatcttcatcaagagctcttgacgtgataaaacctcttctttattatcaataaacatttgtaacaagtcatattctactttagtaagattaatcagttcatcaccaacaaatacttcatgcttacttaaatccatttttatatctaaatatttaataattcctttaaaatgtttatgataccgtcttaaatgagcttcaattcgagcaatcaaaatattagcttgaaaaggtttcattaaataatcatcagcccctgattctaagccctttataatatcttcttgttcactgcgagcagttaataaaatcatcggcttaatatatccgttattacgacattcttgaattatttgaactccatctttatatggcagcatccaatcaacaagtactaaatcatactcatttgataaaatctgcttacaagcatcttttccatcataaagactatctacctgatagtctttattagttaattcatggcaaaggatcttgtttatcgaaacatcgtcctcgataattaataacttattcatctttcccttcatacctttctataattctttgaacaactggatgacgaacaacatccatagcagttaaatgaataaatgaaatgcctttaactccctttaggatttttagtgcttttattaatccggattcaactccacgaggtaaatcaatttgtgtaatatcacctgtaataatcatctttgaattaaaacctaaacgtgttaaaaacatcttcatttggttatcagtagtgttttgtgcttcgtctagaatcacgtatgcatcttctagagtccttccacgcatatatgctagaggagcaatttcaataacccctttttcaatcaaacgttcagtttgttcaacacccagcatatcatgcagagcatcgtatagaggacgaagatatggatcaactttttcttttaaatcgccaggcaaaaaacctaaattttctcccgcttcaactgctggtcttgttaaaactatctttttaacaatattatttttcagtgcgtcaaccgcaaatactactgctaaataagttttacctgttcctgccggtccaactccaaaaacaacatcattatttttaagagcaaagtaataatctttttgtcccattgttttaggataaatcatcttaccactcgctgttttagtaatcctaatattgtataattcactaatttttcctaaattatcttcttttgttaatttcaatgcataaacaacatcacggcgtgtaatcgtaattccttttgcgactaatcctaaaagtgcagcaactactttttttgcttctttaaaatgttctggatcatcacctgtaatgctgagttcatcacctctaagagaaatactcacatttaaggcttcttcaatcattttaaaattctcgtcatgatttccacaaatattatttaattgcgcaatactatattcttctaatttaacttgttctgtcatttaattctcctctttagatgcaatatcttctatcaaaatatattgtacctttaatactcttttgttatcaattataccataagataaaactttttctctatctattttatcgattgaacctagtttactacgaattgtatggagaagatagctaaatgcttcaccatcatccatttttttcttatcgatcttcgcctcataggtagtatacgtatatgctttgatcgttccttcggtttcaataattttatctacttcactagtcgaagtaatcgtattagaaactagcagatcacctttttttacatactggttcaacttaaccaaaatatttccactgctaacatcaattttttgaattactccgtctttacttgcataaatattctcaaaattcttttctacttttttagctccaacactatttgtatattttacaaataatacgccaccttcttgataaatatttaaataatctatcttccctttaaaactatcttttaaatcatcataaatatcatttaattgttgataagttctttttttatcaccaacatcaatatgattttcagctaaaacctgattaactaatttagttgtactaggattattaccgataatctcaactctaaaaataaattgattacataaaatcacagtgactgcaaaactgacaactccaacgatgctcaatttacgataaaacattaaaattaaataatacagtattccaacacttttgataattgttaaatgatatttacgaaccattatccgttgataaataggcaaatagaatcgatatgtacaatcatcgacttttgttaattgaaatactgtaatatggtcctctttaaatgatttcaataaccctactatatcctcactgacgacttcacataaatcatatcctaatctcatagaaatcttaagcaatcaatctttccataaattattacttcttgatcactataatatcttatttctaaatctgcgccagttactttaagagtattattagccatctttatctcaataacattattttctaaaagcatcacacattcataatatttgacacttaaacacttattttccatatagatcatcgaatcacctaactaattatatgaatatttttttagtaaatgcgtttaatcgtgtaataaaatagtttcactataataatttttatactaaaatcattttagagatgcatatgacatacctattaacaaaagtagcttaaacttatatgtaatgataaaaaatgatagtgatactagtaaagattttgaagaaattaattttgcattttttacattattagttaatcgtcaaatactcatgatttaatcttgcttaataaaattatcaatatgtttattatgcaatttttaatcaaagcaatagattttttaaggagaaaaaacgatttatattaccgcagataccctcgaccatcaaggttgttttaatgtgtttaatcactatttaactaaacgtgatattttattgttggagatttcggctttgtgtttcacaacaatcaaaaagagctggattttttaaataaattagcagcactcccctatcaaatctgttttattgatggaaatcacaaaaacttcgactatctaaatcaattacccattacaatatagaatggcggaaaagtccattttttaagatcaaatattattcatttgatgcatagacaaatccttacaataaaaaacatacattttttgctttcggaaaaagcattttcaccaacttggcaaatgggagtcaaaggatataattggtgggaaaccgaattaccaaacaatcaagaagtattattaaatcttaaggcacataattttaaaatcgattatattttaactcatacgtatcctaaaagcactgtctattatatgaacctgccccctatacgcggtgagcttgatttgacagaatttttacagttgattgaaaatcaagtaagccataagcattggtatttcggacattttcattatgaaaaaaaataaacaagatgatggcttgtttattttttaatatgattaacctttctaataaaaaagtaatttatacatactatgatactgattgattcttaaagacagatttatttaaagtctgtttttatcttttcttagtaaaagacacaatattaacttttttataatttaataactttcatgaattaaaataaaaaagggcattagccccattttttatcttttacctttgttgttctttcttgctgcttcagattttaattttctttttaaacctggttttacgtagaactctctcttacgagcttctgcaagggttcctgttctagaaacttgtcttttaaaacgacgtaaagcgtcatctaaagattcattttctcttactacagtttttgccatcgaactattcccccctttaactctaaattacgttcctattatatatataattcttggtaattgcaagaaaaataaggaaaaatatccattatttaaaataatttacattttctttccaacaacttcagctattttagaaatttgttttaataattcttcatatctttccggtcttaatgactgtggtccatcacacagtgccttctccggattgttgtgcacttcgatcattaacccatctgctcctgctgctactgctgcttttgccattggttccactaaccaccatttccctcctgcatggcttggatcaattataattggtaaatgtgttaatttctttactaccggtatagcctgtaaatccaacgtgtttcttgtatatgtctcaaatgttcttacccctcgttcacataaaattacattcggattcccgtttgccatgatatattccgctgacatgatccattcttcaaatgtcgcacttaatcctctctttaataagattggtttctttgttcctgctcccactttctttaacaggtcgaagttttgcatatttcttgccccgatctgaattagatctactttctcattgaattcttctaaatactgggcatccatcagttccgaacagattggcaatccagttgcttctttagctgcaacaagaatatccagaccagaagaccccattccctggaatgcatacggtgaagttcttggtttgaaagcgcctcctcttaaaatattagcaccggcagctttggcagctttagcaatctcgattacttgttcttcactttcaacagaacatggaccagcaatcaaagcaaggttgtcacccccaactttaacaccagcaacatcaacgatcgtatcatcaggatgaaaagcccggttagcaagtttatatggctcagatactttcatgaccttctcaacacatggttctacttcgattgctttaggatcaatttgagttgtatctccaaccattccaataattgtttggatttctcctttagaaacatgtggttcagcccccctagctctaatcacatcttcaatttttttaatactttcatcactagtatgtggtttcaagacaataatcattttaatttcctcctataaataaaaaactcatcctaatcaaaggacgagatatcttcgtggtaccacctttattcactaatagatcactctatcagcctcatcaagtacgctatacaactatagttcatactcttacacattaacgggtgtcaccggagatgcctacttacttcaacattctactccttgatgtattcaactatttatttggatatcgtcacaccaacccgatactctctttgcctaaacgcctagtttactctttcaattcatcgtatttattatatgaacttataataccgataaataatcaaaatgtcaattaatataattattttaatagtccttttaacacttttctaacattatgagcagcatcttcttgtatttcaataatcttagcccctcttgatttcgccacttctcttaaatcacaagctatcgccgtatgatacgaacagccaataacaataaatatatcattcttttttaatgcccctaccatctcataggccttttgataattaggtgccggatcaccatataatactggtttattaaataatgaccaggctatactcaattcatcttcttccggcaatccgccatgcaattctaaggcatcgctcccagcctgtttatgtagaccatcgatattcattgtaataataggaatatcatattcagctaatgcaatatgggcatcgttaggctcagccccattcatgttagcttttaattgtttgattacttcattatattcttcatgatggttattagcataatttctaaataacttttctctaacatctggtctttccataaaggttggaatattactttgtttacttatccctgcaccagtaaatgctactattttcatcattatcactctccaattcttgcacatattatatcacaaaccatttgtttataaaaatatcacctttttctcaagtaatttacaatctaacattctatctatattattagcgtatctattgtaaccatattcaccacttatcatgcctttttttaaatatatacaactattatataatatataattctattaataaggctgcttgtattattttaaaacaattaaaaaataattaataaaaacacttgacctaaagtaactcaaataaattatagtatgattagataaaaaagagcagtatatgtaaaatatgtttattaaatatttatcccttgtatattgacaaagtacatgttcttatataaaataacaattgttatataacatgtgttattttatatgaaaggagtcaattatgccaccaaaaacaagaataacaaaagagttaattattgaaaaatcatttgaaattactaaatgcgaggggattgaaaatctaaatgcacgctatctcgctaaacaactaaactgttcaacaatgcccatctttaaggtttttaatgatatgaatgaattaaaatttgaattaaagaaaaaaattgatgcatattacaacgatttcatcttagcacatcttgataaaaataattatctttacacgatgtcttttgcttatattgattttgccatcaaagacaagaatctatttggagcattgtttgtcaatgaatttatcaaaactcgttccattgaagaagtcgtccattccgcttggaatcgtgaaacgattgaatattcagcacaacaatttggtattacaattaaagaaagtgagatactttatcgtgatattcgtttttatacccatggaattgcaactcaaatatatggtggtaacatggctttaaaagaggaagagatccaaactcttttaaaaaatgctataaataaatttctaaaatgaaaaatctaagaattattaaaaaatattttcaagttactaaagctaataaaaaaataacctttatactggtcttagcttctttattagcaaatggtccttatatgtttacaagtttattgtttagcttaacgattaattatttaactaaacaaaatagtaaaatggtcataattaccatgatcttgtattttgttcttaaaatagcatcaaagttatttaaaattatcagctataatattgaaaaaaagctatataatgatgtctacctaaaattacaaaatgatatgattaaaaaattagatattattaatatgaaatactttactaatcacagcaaaggagaaattcttaatatcgttaatggtgatattaaattactcgcagagtttggtacttggctatctcaagctatcttgctatttctatcttttattatttcaattattattcttagtcaaattagtatcagcttaatgatcttaggatgtatcatcaataatatcgttatctatattttaaacatatataatgataaatttgaaattctaaccaaagaaggaaaattgaaagctgatgatgaaatgcaattttacagtcaactgcttaacggtttacgagatatcaaaattttcagtattcttgatcaattacatgccaaatatcaattgttgaacaaagcttatctaaacattcacgataaacaaattaacaataaaataatcagtaacataattagtcctagtatcacaatgtgtacagaaattattctaatgttctatgcctgctataattgtctaaatggcaagtttgaaattgacacagtactcattatccagtcttattttggaactttattcagctctttaagtgactttatttctaccttaggtgaactcagaataaaaaatgtatcaattgatcgttatgataattttattaattcatcgtgtaatgaatattttcttaatgatgatatggtcaaaccaaatgaattttgtattacatttaaaaaagttactttttcttatcgtgaaaaaacagtctttcaaaacttcaatttaagcctaaagtcaaattcattaattgcaataatcggtcccagtggttgtggaaaaagtactttattcaatttacttttgcgctttgaaaaaccaactagtggtaagatattgattggtacacatccaatagacaagtattctaggataaaatattcacagattttaacttgtgttgcccaacatccgtatttgttcaatatgtcaatttatgaaaaccttgcacttattgatcctgatatcaataatatcaaaaaagcttgtcaacaggcagaaatcgacgaatatattatgtcactaccaaaacaatacgatactattttaagtgacggtgctttaaatttttctggaggacaacaacaaaggctagcaattgctcgagcacttctaaaaaattctaaaattttattatttgatgaaataactagtgctcttgatgaaaagacttcatatgaaatttttcaaacattaattaaattaaagaagacacacacaattttaatgatttcccataaaccaagcgaataccaacagtgtgatcaaattataaatttatcgttctagtgttattgcatctaaaaacattttatttgaactcacattaattttttcacgtattaaaaatagaattcatcatttactgatttatgttagactattttcaaggagtgtgaaattatgattaaactagttgcagttgatatggatggtacttttttagatgaccaaatgcattataaccgcacaatttttagaaaaatttataattattttaaagaaaatgatatttattttgtagttgccagtggcaatcaatattatcaattaaaatctttttttgatgattatcaagatgaaattacttacattagtgaaaatggtgcatatatcattgaaaataaaaaagaaatttttcactgtgaaatcaataaacaagatatttatacaataactaaaaaattacaagaggattctcgtattcaaatatgtttatgcggaattaaatcagcttatttattgaatgcgtcaaatgaattttataatgtatattctaaatactatcaccgacttgaaatgattgaatcgttagatgaaattaatgacacgattgtaaaatttgctttatttgttccagctgaagattctaaaaatattttaaataggctaactgatgatatcggaaatatcattaaaccagtttccagtggtcatcaaagtattgacttaattgatccacgatataataaaggtactgcacttgagctattatgtaagcgctataacctatcattagaggaatgtgctgtatttggggatagtccaaatgacctagaaatgctaaaaaaagcaaaatatagttttgtaatggaaaatgccaatcaaagtattaaaaatattgcctataagattatcccttcaaataatcattatggcgttttaaaaacattattagacctttttaatgtttctaacattaccgaaagagaaaaagctttattagggatgtggtatgatgctaataacgatcaaaaagttttaacagatcgtctgaatacccatcacctttgttttaaatataatcataccgacccactagaccaggatattcgacaaaaaattttaaatgaactattccaaaatgagaatagcaatcttgaaatcatctcacctttcttttgtgattgtggtaatttaatcacctttggtcataatgtatttattaattccaatgcttattttatggatggagccaagatcaatattggtagtaacgtatatatcggaccttctgttggcctgtatacagctattcatccgcttgattataaacgtcgaaaccaaggtttagaaaaagcaatgccaattgaaattggtgataacacatggcttggaggtaatgtcgttgttttaccaggggtaaaaatagggcatggttcagtaattggcgctggtagtgtcgttaccaaagatataccaccaaatgtattagcttttggtaatccctgtcgtgttgttaaagccattgatcaatcataattcacactatcaaaatataagtattactaattttataataaagatattggttcttaaaaaatcaatatctttatttattttttcaatctttgaaaaacctctatttttcttgctcgaagaaataaaaattgctatattaatcttaaaatatgatggatttacaactaaataacgaatagctttgagtatcatctcgagagctattttgtttttcatggagagtatgaggacaagaaaaatgaaaaaactacaaatgaaatataatttattgcatattttatattggatggcaacttgttgcatttacggatatgttgccgtatttcttcaatataaaggaatgagcaacactgaaatcggcattgtttctggaagcgggtgtattttaacgatttttttatctccgtttgtcacatctttaatttcaaaaataaaaggcctaacaattaagcagctattatctattatttatttgattattgctggagcttttttaactttagctttagttgatttatcagttattctaatcatgcttttatatgtttcaatgatgtcattaattgtttcaacagttccttttttatcaatgattgcaatgaactatattcaagacggaaaagaaataaattttggcttagcaagaggaatgggttctatatcttatgctgttagtgctgtgctcttgggtcagttcattgaattttttaacccgactattttagcatatgtcttcgtcatttctgcaattttagatttagtaattttatattctttgccaaataccaatgttaaacaggcaacccataaaaaagaggggaatatttttacaattattaaaaattataaagtcttctttttcattctcttaggcttctcctttatgtttgctgctgcaacttcgctatcaacttatttaatcaatgtcgttaaaaatcttggcggtaatacttcattgtacggtgttgcaatcttcttcatggcagctagcgaaatgcctgttatggcaattactccaaggttaattagaagatatgacagtatcactttaattatggttgcagcttttttctatattattcgaaattttactatttgtctagcacctagtctccctgttttattcattggaatgatgatgcaaagtttatcgtatggattactaacagcagtgataacttactatgtaacatataacctcaaaagtcatgatcaaatgatgggtcaaacaatgatagggattatgacttctggggtaggatctactataggaaatctttttggcggtattttacaagatcaatatggtttaaatatgatgtttatatttgcatgtttaattacaataattggagtaataattattttttcaactggttactttcaaaagaaacaattgaatacacccactaaacaataaaaaagagattttactctaattaagttaaaatctccttttttattgttcaacctacaaattaaaataattaacatctaagtagtatttatatttacttttagtctaaataatcaggttcacttaataccataattattttttcatatattcacatacccgttttaaatcttctcgtatcggcagttgttgtggacacatcttttcacatgctccacattgtttacaattttcagctttagcttctgaaaccattttttctaactttgctttaaattgatcatgactatcatatacaaaagcattattccaatatttaaaattatttggaatatccactccaaatggacacggcatgcaatatgcacatcctgtacaaccattttgagttcttgcttttaatgtatcacgaacatcttgaatcaaagcaacttcttcagctttcaaatactcaaaatttttaaaagtagctaaattatctagtacctgtccataagttgacatcccgctaagcactactttcacattgggcaaactggcaacatagcgaagtgcccatgatgaaatacttaaatcaggattatatgctttaaatttattttcgatatcttctggtaaatttgctaacgaaccacctttgatcggttccataactataattggtatattatatttttctgccaataaatagcccttcatccctgcttgaatatccatatccatataatttaattgtaattgacaaaaatcccaatcatgatattcaagaatttctttaaaaaccggatattcatcatggaaactaaatccaatattacggattttcccttcttctctaaattcttcacacattccaatcaagtcatattctaatacttttctccatttatcagcatctaaagcatgtaataaataaaaatcaacatattcaacatctaatctttttaattgatcttcaaaaactttttttgcctcttctttactcgaaacattccaaattggtaattttgtcgctaaaaagaaatcttcacgtttatacttttttaacactttaccaacaaacggttcgctatcgccattatgataaggaaaagcagtatcaatgtatgtaacccctgattcaattgccttatcaatcattttttctgcttctttttcattaattttcccatcctcatctaatggaaaacgcatacagccaaaccccaataatgatggttcaatccctaaattgtcaaacttttttgttttcatttaaagtcctcctaatatcctacaacatactttcattatactatttcaccattttttttaccatatttaaatatttttaagaaaaatatttcttcttgtatgttatgatataaaaaaggagtttattttataatggaaaagaattgtaaattatttgactatatactactatttcttgccttgctatcattattctacttcattatagttgtcactaattctcggtttatcaatgcctatatactttatccgatttttacagcattattaatgtgttatgctgtatatgagttacattttagaaaaagtattctatcctcattacctaaaattcttaattattcaattaaaggaattattattattagtgtaattgtatttataattatcgagggtttaattatacatgaggttaataataagtataacaaacgcagtgatttcctcattgttcttggtgctcgtttatacggcgacaaacctgcaccactattacgttatcgattagatgcagctgttgaatatcatcaaaaatttcctgatgtcccaattattgtaagcggaggacaaggccacggcgagaacatcacagaagcaaaagctatgaaagactatttaatcaacaaaggaatagatgaatcattgattatcgaagaaaataaaagtactaatacaaatgaaaatattatctatagtaaaaaaattattgaaacatcgactactgaagactatgaagtagttataataactaatggttttcattgctaccgaagtaaactattagcaaataaacacggtttagaagctcatacatatgcagctagagaaaatttagatactgctccacactattatttaagagaattttttggatgtttgaaagatatgatattatcttaaatattccacatagttcacacatttattgataattaatttagtatactattgaatggaggggtgattatgtttagtaaattatatattaccattaaggcaagtgacaaatttgacgattcaattattgatcctatttcttttattctaatagattggggagttgatggaaatctaatcgactgggatatttatccaagtcgtgctaaattagaaattaatactgaaaatgataattatcagacttatagtataacttatcaagggatgcaaacaatcatggaattgtgctatgagtgtgaatttgttatgacaattattgataatgatgaaaaaagcgagagttatacaacatatttcagtcgtgaaaattccaataactttgaaacagatatctcagaattattagaataaaaactcaaagaatttaaactttgagtttttttattttttttacattttctctttacatttatcaaatttttatatataatcattattgcgttgagagttaataacctcttaacaaagtaaatatggcggtcgtggtgaagtggttaacacaccagattgtggctctggcattcgtgggttcgattcccatcgaccgccccatttatatttttagtcgaaacatttcgcactttgcaaaatatagtaaaaacgcacaacgcactttgacaaataaagtaaaactgcactttgtaaacttttgcaaactatagtaaaacaaaaaccaaacggatacctttccatttggcttatcttaatattcgactattgattaaacaaattaatatgttataatattagcaaataaattaagtaatttatttattaatatatataatgttataaaaataacatactaatctgatttctatttgaaatcaacatttagtttccaattcgactggaaattatcgtattaagaatgcctaggtggacaaataaggtattcttttttattttgttttgttttgtttttttctttgccattattctatcacaatcataataagaataatacaaattgtttattttttttcgtcttttttttcagaattttttactcgttcatattcatcactgatccagaaagatatcaaagagcttttattaactccttttttttcagccagaaattcaagctgttccaaaatatttagatccaatgtaataaatactctttttttatttcctgcaacactcatttccgtcacctctttttattacaatataattatatcatatatgttacacttttgcaacacatatattaacaaaacacgatttttcgtgttttgttaatttcctatatctttatacactatattttttacagctttattcactgtatcaactgtaatctttctaattcgactatgaatatatgatttcttttctctaacagaaagacttaaaaaatctatatcattatccatttttattaacactttgcgtttcaggttaagacaatccaactcatcctctaaaggtattattaatgaacagaactcacgttcagtaatctttttatacaggtatctttctcttaaattttttatccttctgtttaatgaatatctttttttatcaatctctttaatctcagctttttgaccgtctttaatcatcctatatttttttgtactgattacttcgttaatttgctcctgagaaattttgccattacattctttacactggtaataataatatattttatttctgcctttaccgcttgttcctgtcattactttattacaatttgcacagtatataatattatcgtatatgtatcgataattctttctcgaacgtcctacctttaaactgtctatagctttattttgtatactttttgtaactattggtggcactatgtttgtatatttctttcctttatacaagagaacacccgaatatcgttcatctttaatcatctgtttaacagattctgtactaaactgtttttttttgagacttatttaaataatctctaacatctgatgtttcccattcttcaatcacgtagttgaaagcgtttctgattatattatatacttttttatcaagttgaatgtttttatcttcgtccctgtaccatccaaatgtcattttaccgccacatggatatctaccgctttccactatgctgatcaacccgtcatttgttcgctctattgtcctctctctttcaaactgattgtttgacagttttatatttgtactaaatctgtcgcttgcagtatttatttttgcatcatcatatagacaaataagtttaataccatgatttaatatcaactttaaaaataaattactgtcctgcacatctctggatattcttgcaagatcgtatgctaaaatcatttcaacattcccattttttatttcttttaatagttcattcattttcggcctgcaaaggtcaccacctgaaaaaccatcatcgataaagaaacttaactcgtcagtactttttataagatttgttgctaaagcatgttcggcaatcattcttttttgtgtatcaatcccaataccgtcacgcgcttgtttcatagtcgatactctacagtaggcaatttttaatttcatttctttctccctcttttcttcattatgccaagaggatagttaatgaaaaaatccttaactatccagtaaataaatttacactagttaatcaaaaaattctatataccttttattattttctacttaataataatccaaaataaaagagattaaataataaagtttaatctcttttttctgggtctaattctatttttttactatgattttccttatctgtacttccaatttttcatcagtactttcattatcaaaagtttattttgggtgttttctaactaattctatatacctttttgcttcatcaacatcacatcccatgacactgctcatccaagacgatctcttttctcttggagttttattatccataagaatgtaatagattttcaaaagttcacttgcaacttttattttctcttcctcactaagttcgttatctcgacactttacagttagtgcatataatctgttttttatactttttttcctgggtttctttttaggtactctttttttatattttataggatctgatgcgattatctcatctattttttttatttgtctttttcgcatttctgcaactttatcacatctggccaaaaaatcttttacaggaaatcctgaaacaacaaacgaaaaaggcatatacagctctgtattttcaggagtattatcatgttcttcaattattagccccacttgaaatatatttattttatcagtaccatcacattccaaaagaacataatctcctatacccacattttttataggacacataaaataataaatttttgcagtatctttaatcggtttatgaattcctttttttaatcttacccctacaatcttcattcttttctctccaatctaattataataatcactatagcatattttgttttaataaaaggcacaatttattttacatatccttcttaacatacttgcattttggatagctgctgcatgcaataaacttgccgtatcttccgtttctctctattaacttactgccacattgcggacatagttccccagttcccctactttcatcttttttgtctttctgaatatatttgcatttaggataattgccacaagcagtaaatttaccatatttacccgttctttccactagtttcccaccacacttaggacactttttagttacgtctgtaatgttagattcagatgtctttttaaaaggtatattattttctttactttcatcgaccaaattaaaaatcagttcacatccagatcttgtaataaacgttgcattcttacatgtattcagaatttcagtttttgatttttcaatatcatttatattaatttttttcatccaggacttaatataaaagttgtaaacatagttcttttcttttaggtacgcatatgcttcaaaacagtttttaactattagccagtttttttctttttcataatccagctgttccgttacacagtatcctttttctactaaacgttttaatttattagaattacacgcattatcctttaagttaataaattcattatagcttactgttcccattttaaataacgtcataataagctcaatatgaacattgtaaaaatctttactatgatcagatgtacctctgttcatataatcaatatgatgacttagttcatgtattagcgttattatacaggaaacgttgtttctacttttaacattaaataagtgtatagctttttttgaaaatatgtagtgtcctaatgtgctttttaattccttatcagttaattttaaataaaatttatggtattttgccaacatatctggttcgactgttcctttgtagcaaaaatcgattaaatcatctaaaaaagcttttattattatatacatctgcattctccttctaatacgcatttattataattttgttctttcttttattactaaacattttctactatcaaaataaaagcagttaattctaaagactactcagtttctccaacaaaaaaataaaaagcacagtttatttgcctatccctcttaatatacttgatacttgcattttggacagttgctactgacggcttttcagcaattactaatttcatagtattttactcctcatataaatttaaaaataaaaagaggcaaattgcctcttttaaagttcgttttcatcttccaagctttcctcgctgtaacttttatcaagatgaaggttgtattcttcacaaatacatgaaataaatctataagtttctgttaacgctctttcaacttttttttcttccagacggtaattcagaatatatctagtccttgattcccagagagaaaacatttcactatgatcatcaatatattctgtcagtggaatatctacttcacttttattgattaaagcaatcagctgagtgatatcatgggtcttaggatattctactccattgatttctaaacagaatttaagcgaaagttctacagactgctgtaaatgatagccaacataatttaaatatgcctcatcatcgtatctatacgtttcatataatgtatttgcaatatttagattttgatttgccttatctaaaagtgtttcattctctttcatagacaacaactcctttcttaaatatttcttttttcatattctcatcaacagtgtaattagtccacaaatcataaagaaagtctaaataatctgtaataattcttttatcttccttaacttcaacataaaaatcaacatcactgcctgcatggcactttgaagtcacactagatccgaaaacaataattttaatcacattgtcattgttttttaaatgatttatcattttttcaacctttttttgttgaatcggataaatatacctgcaatttttaaaaggagtttttaaaaaagatttccattcattttgtctttccatgatatcgcctcctattacaattataacaaattattgagtaaatacaattatgctatcgatacagttctttttagtatcctttcatcataaggttaagcagctgctgtgtcataggtatttcacgtttatatctaggtgacagccccaaactccaccgtcccccatcttcaacatacaaaattccaatccctttttctttacacgctcctatatatttatcacttatcacacttttacgatcagcaggaataacaatccaactcttgttaacaagttttgcattttcttcagcctgtctaattacttttcttatatcggtcaatttaaactcaaatgcgtttatctggaagttctcctgatatttttcaactgttacaagatcagcattgccttctctaatactgcactcaaactgatatatcaacgctcgattatttccattgtatgatttccaaaatttatcttttaattcattctcagttaaaaacattttattcctccattttataatccaggtctttgctaacttatctgttatctataataaattcatttagacttttataactcctaaaaaccactgaattatttaacatttttctcattatattttttttattttctaattcatcatttattttcaaaatacaatacagagtctcattggtaattagcgattctccaattaataaacattcaaattcatcgtattcgctaattgctttttttaaaagtgattcatcttgaaagagatcgcacaaatcacttaaaaacatatctaccgtataaaaatcttttacatcatcatctgtaacgaaacaattatttttataaagtttactctccttaaattttaccatgctttcatagagtaattttttatcaaaagaacaataatcactataactgcttttctgtttataacatcctaaaaattttccatcaaatattacatcgcattgatagagattattatcacttttaaaattcactattgtgacaccatttattttcatgatttttaccccactacttaataaaacaattaaaagcatatattaaataatatcctataaaatatagaagtaatgtataaaataatacccataagataaaaaatcttccaagatagcctctcacaagccaaattccaccttttgatccttttgacgagttacaactcttgcaggcacatacgaggtttcttttatcattaatatcttcgattccaaatttttttagtagtcttatgttaatactggaatacgaactgtttttaactttattgataggaaaaaagtgatctactgtaactttatctttttttaagatttttccacaatatacacaatgataatatcttccatcaccaaaaattcctttattgttctcaaaatatacttctctgtagttatgagcccttgtgtacgccagatctgttatatttactctcagtttattttttatacagtactctttgattgcatttgctttatcttcatctgccttgccgacccacttaccagaatattttcctgtttttttaaaagataacccaaatgcatttaaatcgcacctgcagtaatatgttttattaataccgttgtagacttctatcagtttcttcattgtcattagtcacttcttttttttggatagtattttcaagttcattttgaattgctgtcaacttttctttaactctgtttaatggtgttaattcctcttttgcttctttctttattttctccatcttatctatttgattttgtgcatcattaatttttttctccaacgctgctatttttttatttaattctctaatttgtttgtccataacttatccatcctttcttaaaatataaaagaggcaaactgtctcttttatatgatttatttttataatgagcgctcaaatgaattagtcctaatttctttctgtgctttttttaccatatcgtctaattctttttcaattattcttgaagcattactgctttccattattgcttttgacaattcatctaaaatacctgcctgcaacagagaacttcgacaactcatagaatgcttcgatgcgttaacagcactaaatttatttatatacgaatgtttcttagcactcgttttgattgtttcctttttgattttattttccaatttagaataatgttcattatccaaacgataatttttaatattctgcaataccatattggctattctagtcctcagctccttatccttattctcgaaggagcgattctgctccatcttctcctcatcactaaaataacggttattaaacatttctttttctttttgaagatgttttttatattgacagtaaaataatttaacattatttgtatttaaaattatgtcaacaattttatcaatatcatcatgatatggtcgaatgttttttgaattatattttaaactcccgtttagcggtaatttatcattgagatctaaaagaagattgatgattccgttatttttcttaaaacacttttttgaattattttttgaagacttaaataattttattaattcatcatttttaatacaatttaataattcctcttttaaattatctcgttcgatataaatttcgctattaagtgccattgttctaataacatttgaccgtactttattaaatttcttttttgagattttataataacgttttgttggttctttttcaaacatccacacatgacagtgcggattatctgtattggtatgataatatgcgccccattcgacattttgcggatcaaaacctaatgcacgaatatttttctccatagatttagtcattaatttctgcatattagtcttagtaattatattactgttctgggcaaattccttttcgaaagaaaacacaaagcgccataatatttttggctgatatttttccatcagcatgtttgcctctcctttttcaagattaccatttctattaaatccaccagtagacccgattcgatagtcataataattgaaagcatcttgtgaatttatctgatatgtgtcatcagcttcgttttcatcaacagtataatcacaagcttcttttcgctcatagtaatcaaccagctcatcagtattaatttgttttttaatatttttacagctgttgcctgcatattctgttttaacaaattcagcattaaaaataatttcagccatttcttgctttaccgtccctaattactctagcaacacttgccagttctcttaactgcggtactgataaatcatctattttcttcattaacgtagactgcttttgggatgagttattatcaaatgactgcaatgctgtctttaccatttttactctatcagccgattcagttgaatgcctctgtttatctgctacatctattggatttatataatcaaaaaattcttttgattttagatatttcattatttcttttcttgatagtattttgttgcagttggcaatatgctgaataacatgcttttttacactttcagacagatcatctctcatagaccagtaccagtatagttctttttcattaggcattgaatttttttgagtcagtattggtctccttctttcactcatactaattgaattacaatcttcatctgtataaaccgcttgtcttatttcagtttctcgcaattcaaaacatctcgggactgcccagtttagttccctgtctgctttactaatttccgtttcatcagttttcatttcttcgtaccatggatactctgagcagtcaggtaaatatacttttgaaggagaaaagtaagtcctcttaacaataataccatttccatcacgattgtccgccaccattaattcatttgcatcaacaagctgtcttttagacattgaatagttcacaccactgccagtagaagaagcaatcgggttataattggcactatggcttggaccccagattgtttcatcaccaatactctcagcaacttccttgcatgtattcaaatctgcacttgagataaaataagtaaggttacagtttccccgaataattcttgcaatcgattcatcgtatctatcattcagctgatcaaatccctgcacatacaagtggtatacaattcctctagaaagggctacagtcattttgctctgcatcgcatcaattgtaggcatattcccaaattcatcataaatcatgtgtaccttttttttcaatcttcttccctgcattctattagcttcaaagactagagtttgatatgactggtcaaaacatatacctgcaattctatcataagtttttttctcatcaggattaacaataaacaaagcacgcttgccctctgtaaattctctgaaactgaaatcactcttactaagtaccttcatcagtttaatactcgaaaagagctgtaaagttgccaatgcacttgtcataaaagaacctctcgtcttttcaggtgaattagtaattgtcgtataagctgttcttgctatatctgtctcatcaagtgaattcatatatgcagaaagtttcatcttcttgtcgttaggattattgttgtatgcctgctcacctccaagaagagcaagcgtctgataaacagaataaaaattctttttatcttcagatacattagcctgacagtttgctaatataattcctttaataagtgccttttgaccgtctatccagatttgttcacctttcccactatcaacaacgattgatgttaccatatcctgactgtactgatctgcattatcaatatctggatcatctctatcctgtaaacagtcaattattgaatctaacggattccatccgtcgctgtattgtaaatttctaaaatcaagacagttaactttataatcttttttcttctccagaaaatttctaaaatcaaaatacatttcttttttagggtcattaaatatcattgattcacctgccatggaaactatcattacaagctggcgaacaatctttctagattttccgcatcgtgttgttccaactacaatatcatgtacagctcccttttcatataggattatgttttcattaggtagataatttatcggtgaacctccctcctcaagattaagacttgcatccaccacggttgaaccaaaaaattttttctgttcactaacagtagaccaacactgacttgcaagcatatccgtcttttttggttttaccgttctgaaaaaagtcactacgtaataaaatgccaatgcatataaacttacactgataattaatatttcttttgaatgggatacaaaggtatttaaaaaattttcatcaacctgttgaagtacatttgtatccagataccagaatacaaacgttataaaaattggcactaacaaaataacaccaacaattcctatcacattgaatatcacttcatttgagatagtcttttttttatcaggatctctcatttacacatcccctttctttgaataaataaaaagaggcataatgcctcaatatgataaattcgtccgacaaaaagtgaatattcttgaaaaatgatttagaaatcattttttgaatgaatactgaatcaaaaataagtaggaatattcactttttgaagacaaagacggaaatcgtctgaaaaatgactcaggaatcattctttgaggaaaataaagaggaaaaaactgaatattatttgaataatattcagtttgtccgacagtgaggaaatcgcctgaagaatgattcagcactagttgttcgcactgcgaacaagctccaaatatgcagtcctgtcggactgccttatcctgctacctaaaaatgattgaaaatattcagggaatatttggaatctggtatggaaatatttgggaaaatattggaatatttaggtagaacgaattaataaaataaatttcttgcctgttgttaaatcaataggcgagaaattctttccttttctttttggttatttttttaataatcaattcggagtgatcaaataattcaccgcctccaactaaccattttccaatatcatcaatggaaaatgcgattgatgcaagtccttcatttgcaataattgacatcagcattgaataatatgacgggtcatcgttcataaataaaagcagttttacattaggattaatcagtttaaatgtccgtagaattttgataatatctttgtttttgtaaaaagatttttggataattacatgcgaaacgtttctatagccaccagtgttgtttatagaaaagtttatatatttatttgtcatgatgtgtctaacatcactgttagctctatcaaaaaaatgtacttcacgatttaaatcttcatcaaaattagaaaactgatcatatatttttaagtaaacatcctcatcagcatataaaattatctttataatatctttcattttatctcctttaatatctggcatgattctttttgttgtcaatttcattaagtagttgttgttcgtattcactttcaaaaccgtatttttcttctaagtatttcaataaatgtttatatttactactttcatatcttgcttcttttaatgttttagcatatgtttgaagaattaattcctcaaaaaaatctttcatctcatactttgttctcgccagttccgtattagtagtataatcacgtaaacaaaaaataatagcttcggaaaagctatcacactcaaactcatgttgaaaaaatactatcttatcatgtaaatcttgcggaaatctaattgttttttttactgctgatgcgaagttttcttgtaacaaactataatctataccaaattcttctttgattttttttggtgcatcatcttcaatttctttataaaacccagattcaaaccgctgatatcttgataatgaccatccaagtttttttgaaatctgcaattgtgtaatatgcaattcttttctatgctttttaactttttcaagatattcctcattaagcttaaccattcccatcgaccattcccctttctttttattaaaataaataattacttaccaatttgattattaataaatttttttgttaatttatgatatttatttcttacatcaaggtatacgtgcagataatattctgtatcttttccattcaaatcatcaagaatttcctctttgtcaagtttatcttctaatgaaatcttattataagaatcaatcatacataaaattcgtgtacgccaaaaactttttttaaactccatactttcacctcactcagtaattaatttcaggatcaatatcatcagttggcatatcttctatttctttaagatatttttgattatcatattcctctttatctacaatgtataaatacgagtatttaatactttcgtcatgataatcacgattatcatcatcaccattccacacaaatttcttatcccaactattacttcttttatcaaattgaactgcgtacaaggtattcatttcatcatcaaccagaaaaaaataatatacaacttccttgtttttttcataaactactgactgaaaagttatattgtcgtaatcctcatcaacataatccaacttctccataaaattttgaatatcattttttaactttactatctgattatcattcatatctaaataataatcatcatgataactgcaaaaataataaatcggtttttcattaaaaataccgcttatattaaaaaaattaaaacctgcatatccaattaaaattgcaattaaaattcctaccagtattaaaaattttataaaatatttattttcattattcattttatcctccgtcccttattactggatgtattttaaacactgttctttttctcttttccaacgattatgccatccattataatattttttcccagtctttccgtactttgcataatcattatattttaatgaataaagataatcatacactcttgaaacgaattctttatcattcatattactattaatcctgctatccataataatagttactgctgtttttgttccagcccaattcgataatgaacagcacattccttttaaagcatcacatcttgaagatatatcgataccctttcctgcaagtccgctttcagctggaaggtaataattattgtattcaaatgtatcctgcatcactgcaaaattttccgaatctgcttcatatacctgatgccatgctttttctaaattcttattatttcttaatttcgattttgaaacattcaaaaaattagaaaacggcgcatataaagtaggatttgtctcataacaaaatcttaaaaattcttgtaagtcatagcgactatcaaactgataataccctaacgcataatatccatcacccttagaaaagcctttattataatcatttcccgactcattagaagcaaaaaatttaaatgcctctgatagagctccttcaagttttgccgaacctgaagatggataattaggagttgcatatcctaaaatagtaccagtttcatttgaaatgctgtaacttctcttcttaatagcattaccactgttaccctcgattgttttgattatgctgccatcacattcttcaatgatgccaacatgggtagaatcatttttatttttatttgatgaaaagaaaatcaaatctccacgttgcggtacatatgagtttcctgcctcataatactctgtataattaaactgatttttttctctaaaccacttaatgcctgcgtcacagtcagcaaattttactattgcagtatctaaaatatttgctttgtaggcgatgtaagagacgaatgttgcacaccatggtgcaccatccgcagtacctgtataccattttcgatacttgtcaccgcctttaacattaccgcaagtttcatactcattattggcaatctgtatgaaaagttcaattgtttgcattccttctcgttctgcataggcatcgtctgatgacactgaaacagaagtaagaaggattgccaaacatataaaaataataaaaagaggcataccgccccccagtaatgtaaccgcaatagttttttttatattgttaattatattcatatagttctaatctgctttaataatctgctttaattcgttcaaactcttctaaatcatcatcaggcaaagtaatatgaattctcattgctgtttgtgaacctactttaaaatagcagtcccccatttcagcaaactgaataaattccatttcactttcaggaatcaaattgctttccgtatccttaaaatatttaattccacctgatcctaatccgaaataaaactgatatgcagactgagaaataattgcttctccctgatcttttacagagtcctttaatacatcagaaatctgctgagttgcagttgtaaggccacccttacgctttctaattcgcttagcaattgtctgaaaatacatcataatatctaaacagcgcggatccattattacaccaaactcatcattatatagttgctgtctaatattttcggtgttagatactatacttgtccatataaaagaaagtacattaaaatactgagttaataatactttgttattggtattatcctgtaatccactgacattaaaacaaatgagtcggctattcaaatcaatactagtgtgaccattgaatatcgaagcatctgctccacatgccataggctcaacaaatgcaatacattctttaattctggttatctcttttatgttaggagttttctcactatttgctatttccagcagtctgtacagctcattataaagatcaagcattattggaaagtctttatttctataattatctacaattatttgggcactggtttgataagttattccaattcctctataaatattttccaacgctttttctatcaaattatcatgaagaagtctaatatcctccttggcgtttcctttataagcatcaaagaatgaacgtaaaaatctaatatgttctgataatggaaatatttcagttaaaggcgttttttcattatccttttcactttcaggtacattaagtctaatttgaagtggattaatcaaacctgacctgccatcagaacagtttatattttccccgcctaaaacatgtaccagcctatgcagttcttttccttcaatatcaattataaactgcttgtatcctaaaccatatcgctctttaataagccacatcaagaatagagtttttcccataccagtcgtaccaacaataaattcattagaattagttctatcaccttttcttacaaagttatcataaaatactacaccgtttgtatttttagtattccctatatatacaggagggtatctatataaaacttccttactgtctttatctatttcttccgttgaatcatataacgcctcatacacaaaaggatacatatatcccattgtatccgctgtagtttccaacatataattttctacataattttgacaaatcggagcagtcagattaaacatttccagtggctggtgtataccatctctaaatttaatattgaattgtttaacatctttatcaattgctttgacggattcttctaataaatcaggactactggcaacaactctaattgaaacgctaaaataaattggaaaatttccatcatttattaatttttctaccatttcaatattttcattgatttccttttgactcttggcaacttttgataaatccttttcattatttgctcttttttctagcgctctaatagatttatctatatctttcgtaatagcatcatgaggtgcaggtgaccagtgaagtgaaaaatcaactcctctggcagtagccagataacacaaaagagccattacaggctctttataaaacgttgctaaccatttagtcttacaatacaaatcatttaatacaattgactgattaaagcccttatcgtaaaaaccaatataatctggatatatacattccattacaccaaactggtctttataaactgaaggaacaaactttccatttgcaggattatagtaattatataccacttctaacatttcctgcggtgtcataagtctggttctttgatatgaatttagatacgaaatcacatctgccaatcttctttcgagcttgaaccagtctttatcttttaatataatcacaaaacatcgatctaccagttctctagtaacacttgtatcttctaatcttatagaagcatcatccaaaatcttatattttatttgatctatctcgcttccaacaacatccagttgagattttaaataattgtaatcatttacataaccatcaacgtctgcaggaacttcataagaataaatttgtcctgaaccagtattagaattaaaaatcgaagcaaatgcattcatatatacattttgatcttcttcttttaatccaaacaggttcgtaccatctgtttttgccattaaaataaaatgttcctcattatcaataaaacattgcctgtcttcattccatgtaacaggaattgcatattttatatgacgtgttctacctgtggtttcttttgtctgctttttttgtttttttacttgctgtgtacctttcttcttggtaaaaatcactattttcttcctccttattaatgttctcttctttgtttttatcacgataatagtaatactgatttggtaaagtaaaataatacttgcatgccagttttaaatgatgtagaacactgaggtgcgaaactggtatttctataaaaagcgatgctatagacgcacttaaaacaactgctatcagcagtgaataaagttcactcataaacattccaaaaaacttaaaactcaaaacacctataaaaaggcaaaatcccatctcaccaacagttaaaaaaagaaaaaacttttctttagtttttcctttattgataattattttgtaatcatttcgatcaaccatctatacacctcctataaattatcatcacctgattttaatatagtaaaatacctagcataaaatgcagatatccgtacatgataagaattattacacatgtacagaacaaaactgccaggcagacaagaaccattagtataattccaagcagtctgaccttgtaatctgaatccccggttagtacttttacttcacaattgaattcgatacataattctttcactttttcatatgttctattgttgaacctctgatataagtgatttttctatcaaaaaaagcataactgataaaatttctacttccttcatataaaattattatacataaatataaggcataactgttttttaaagaaagttcagttaataaatttttgactattatatctggatttacaaaacatgccagacctaaaaatattaaattcatcgctacacattcggtaataaagataaatatgttttttattaccttaaatatatcaatgttgctaaaaatggtataaaataatctgttcatccttattcatcacctcttaattccattttgtctatgaatttcataaatttcttacagctgaacgtatttttgcatgaagttcgttatcccttaattcacttcacgctacaaatgtattttcatgtacattctattttttagtttcattttcactatttcctttattccagtttctaggaccagtaccacgaacccctataacatttgccattccattaacagctttccttgttgtttttgtaggattgtttataaatgacttacctgcattataagttctatttgccactccatctcgtcccagaagacctcctgaacgagcattaacctttgaatttttgttagccgatgttcctgaacttacattcgtgcggctatatttttcatcatttgcgttgtctgcgcctagattagaaaatgatccaatattggcattcatacgtgaacggtcttcaccgccactattcacattgtccccagtatcactgtttagacccgctctgtaattatattcctcattaccgcttctgtttccagattgggcatctttcttctgttgttcctgttttccaaacaaaccatctctcatcgcccttgttctgttagctaagccaccgatccgctgtccaccataatgcttattacccataattgccccacgcaatccgccagttaaatgaccagtattatcattatgtcgacccatgacctttcttccagctcctaaaacagcacctccagtcataccccatgcaccacctactgcaccttttagctgctgcatactttccattattccttgtccataacctccaatcattgactgaacatatttaggcaaaccaataattgcagaaaaagtaccaaaatacagtgcaatcgaagcaataacattactatttccgcttcctgctttagaaatatctccagctagattcattaaaagctgtaacataaaaatctgagtcacatttacaaaaaatatacctaaaatggtatttttccatactgtaaacgcctgcggattttgataatttgtaagtgataaacaacacaacggtccaattacatataaaaatccaatcacaataattctcattgctacttcaattgtaataataaaaagaagtatcataaatatcgccagtcctatcattgttccaatataaccaaagtcccagatataatctcctgcatggtcgcaaatatattcgtatgcctgtttagcctgcgtttcatttgacgggacacttcttgaaccataaccgccatcagactttgatgactctggaaaagatgatgatgaatcccaactgccaagaagatcccagtcatcgctaccgtcagtcccattaccgtttacatcccaacgatagtaaaatgaccatcggttataaattccctttgaaaaaaaattatctgatgatcttacaccactgttttcactaggctcaccttcatatcctgccaaagcaccgtcactgttggttatatagtcataaaatctttcagcacctatatccattcctactccatcttcgttagttacataagaaaatgttgtattatttctatccataccgccaaatgcacataaagtagaaacaaccaactctttcgctaaatctttttgatttgtatcattagatgccgatgatgaattatttaaagatgtaccgctgttatcattccaagaatttccattcgaactgcttccaacgctgtactgttgaccaataagggctttagatacatttatagacagattattagccagaggaactactatacttaaggaaactgcaagcataactcccataatcgctccaccaagcttcttattcacatcactagcattatcatcttctcgaaccatcgcaaaaataaactcataaattatttttgcaggcaaaataataaacatgagagtaattgcagctttatatccatcctgaatccatgtattgtctaaaatcccaaatgataatacgccattaacaagtgcattaattaaatttctgacacagtctatttcagtttcaatcagtttccataagaaatctctaaaaaaattagctacatcctcgctgattccgctaaataagcccatcatcatcattttacaaatacctccataatttttattaaaacaatcgtaataaatatactgatggatgagcatataactgtaaatctgaatatattatttttagcatattctataatatggtctttatacttacttattttgttatttttattggtttcaaatgtgtttatgtgctgtaaaataatttgaaaatttttcttattttcatggtttacattttcaatctcatatcctatttctcttaacacttcttttaatttttcgatctgttcatcatttatatcaaattttgattttccaatattgtaaaatcttttaccaatttcatttaaaatatgattattttctatattcatctttttaacagaggaaatttctccaagcagtttgttcaatagctcgataatttcattatcttcagtactaccaccagaaatatcaaacccatctaaagattgggcgttttcaaaaaagaatggtatatcactagattcgcttgttggaatatccctaacataatatccatattcattagatacttttctctctttaaattctctatactgatctcttattttaaaaattggtaataatatttgaccaccagtatagtcataaaattcaataaactcttcaatattattttcaaaaatattcctaatttcattgattgtcttttcattaacccctgcaataaaaccagatcgattttccttatcttcatcaatccacttattgagtctttctttatcaaaaaattcataccacttttctaacatttgttccaattctatacctcctttcaaaaatataaaaagaggcaaattgcctctttctaattaaaatatgaagataatactttgattactgtaggaattgcaaaaataaaaaccagtcctacaaatacacctcttgttttcttatcccacatttgatcttcctgtgcatcagcaaaaatttgtcttaatttataatatacacccatagctgtagcaaataatactgccattgtctgaaagaacaaaagcgcatcttcagcaaaaggggttacaagttgaattaatggatcaaatgaccccatagtagttattttgataacttccattgtaataatttctttcataaagtctcctttctaaaactacacaaaaccgttataatccttgttccatttcttcactttccacttcgtgagtagtttgttcttcgtattcattaggttttttaaacaactcaaataattcctttcctgttactgttgcttcgataattttatcgccaaatactggtttcatttggttttcaatatcctgaccaacaattttagaacgcattatgttaaatttagagttttttgggatattaacaattttaatatcatctcttccttttatgtctttgatacagttctgactgatagttgctctgcaccccatcaaatcacctgcgtattttggaagtaaaatgcttatccttttatttccctgttcagtttgatacggtttacctaactgttttaccgaaacggtaaaacttaaccactttgtatcttcaataatatctgcaagttcatttggcgaaatattttcaattgcagaaaaaagatgtttatgtctaccatcttctaatctttcttcgctcttgcccaaatctaaagtaatttttaaatacttatagttatcaggaaaatcaatataacataattcaccttctattgcctgacttgtataccagacaggtacgataaatgaggcacgtattgaatctggtaattttcctacttcatttccattttcatctaatgtatttccaaagtcacatccttttggcaaaataaatttatagtaatctttttgattgattgttatacggtttactgaaccatcttcctttcttactaataattttttatttagtttaattcgcataattattcctccttaaattgataatgccattgcaacagttaagccagctgctatagcaatagccagtcttgttacaataaatacaattacattttcgatatcatttttaatcagttgacataaaaaaacgataaggcatcctactgcaacaactacaccacaaataattccaataatattcatttgctttttctcctttcaaaatataaaaatatataataaaaaatccattgacatggatttttattatctaaccgaatgttacttgatatcccttgccatctggcattaatgaataagaatttacgaccccactgttcactttaccctcggcataacttaatgcttcattgtatgtagcaatcgaaacctcagaaaaatatttattatactgtgagggattggtaaccttattgccacctgtcccgccactcgaactattatttgcattatttttattattatttgaattttgactgttagcattgttgtttgtctctttagcttttacatttacattaatttcttttgcgagatttccacatgtgactcttataattgcagtacctggagacactgctgtaatctttccattatcaactaccacaatagtgttgttgtcgctcgtccaatttacagtttgatcttttcctttaaccttcgcagatacaagcaatgtctccccaatatttaatgaaatattagttttgtcaatctccagtgaagccttttcatatatattcaaaacaaaatcaacactcgatttatttcctgcttcatctttagcaaccaatttaagattgtacttacccaattttttagaattataatcaccttttattgaaatcctgatatctttcttcttggaaagattatcctttattttgtaatctaaattcttttttgaaaacttttctccaaccgttaaatcaatttcattattttgtaatagaatcaaaggtgcagttatatcttttacagttacttctactttgtatttgtaatcacctaaagaataaacaagtacatgtttacctaattcatctgcatcaaactcaggacagataatactgtaattatcaacagtgattcttagctcatcctttaatctattgctgtctttaatttttatatcatctatacccgacacaaattttgtagtatcaacattcttttccccatagtttattactatattgctattaaattttattttatctttgctgaagtttggatcactgaataactcactttgacagccactaataaaaaacattaatataagtaaaaatattacaacatatctttttttcatattctccacacacctttctttttttgtatatgccatctaaatttttaaatagcatatacaaaaaagaggcaaattgcctcttttagtttaattaacaactttttttccttctataataaacaagggacattcctaaaactgcaacacctgttaaaacaagataactaaacggattgcttaaatcaccagtttttacctttttagcaacaggcataagttcatcatacattgttattttttgaacttctccagtattgctaactgtaaattctttattttgtgcaattttataatttactggtgcaattacttctatcattgtatatgtttggccaacagttaatccagtaattttatgtggtgtttttccagatacccattcatctacaatatttccgtttttatctttaatttgcaaagttgcaccttcaagctcttcctgagaagttatatccttcttataaaattcaaattgagtaatttcatctgtcatgtcaacagttaaattttgttctttatttgttttaaagctaactggctcggctgttgcatatccatcaggactcttaagctctgtaataacatattcctgatcttcaactgtacctctgatcatatgtgttgtttcatcaccgttgatatcgatgttataatatttagtttcaccatttgcctgcattaaaagtctataatcatctctatctgcattcttagaaattctgtaatatgtacttgaatcatcttcaatgttaataaacatatcactaacaacttcacctgatgtaagtttagttttcatatcctcagtaatatcgaaaatatgttcaccgcttgtccatttatcaacaatctgtttagttttagtacttgttacctggaattcccctccttttaaaagtttatttccatcgtttccgtttttcgcaaactcaacactgaaattcttcatttcaatatcttggatatctccatctttgacagtgaactcgataggttttgctaaaacataaccttctggagcatttacctcacgccaaatataatcaccagttggcaatccgtcgatttctagatcattatcatctgtgatccagttataaacttgttcaccagttttggcatctacgatttccattggaacaccgtaaagattgtcgccatcagcagttaccttgctgaaaactgtttttgttaattcattatttatatttaatgaagaagtgtaagttaatgtaacaaaatcctgctgtgcaaactgtaccgttttgacttctttatctaaaacaaaaccatctgggcatgcagtttcttccacactgtatgtccccattggcaatccagataaagataacttaccatttgtatcacatgaataaataccgttttctaattctttaccattcactaattttacgacatcatcattgcttcctttacctgagccaacagtaatcgcatctcctttagaatataatttttctaaagaaacactatcataaatatcttggtttgcagtaatcttgaattgtacttttgttaaatcataatcagctttatttactgcattttcattagaagtttctaaagacttatttatctctaacgtacctgtaggtcttaatttattgacaacgatctgttctgttgtctgatctttattaattgttacctgaaaagtcttttgaagaaccgcatgaccatcaggtacttttgtttcagtgagcagatattctccaacaggcataccgctcattgataatttgccatctttgactacaagttttttttcaaaatcaagtgtagtatgttttaatgagaattctgaaccgttaatcaattttcctgtatcatttgtttttcttaattcaaaatcacctacatccatccactttacttttaaactcaatgtacgaggatcagtagtaaccgatattgttccttcagtttgatagtttccacctgcagaaattgctaaaggcgcaaacattgtaagattattacctgccaattccccgctactataatcatccattttttgtaacggtgctgacaaataaaaagtatcaccaccgttaatcgaaactgttccagtatttactgttccctttgttacattatgaagctctaccccgttttgtagtggaatactaatagttacctctgatgatgtatttaatgttatattttctgttctctgtactccttcttcaaaataagcttgaacattattatttgttagattaaatgtttttgttggtacaggcatagactgaatctgatcgtatctcgcttttaaaccaacaccatgtgcttctaagtcatcccaatcattgccaccatataaatcacctgaatatgcataactagccataatgtgcgtataaagatatttagtagtatcatttgtaacttggtcgtctctaaatacatcgccaggtccgccaaatccataatataacactttcaataaagcatcattgttttttataacataaggtgcatactgcccttgtgggggagtttcttttgatgcttctaaacaatacgctaaactgccgtttatatagcacatttttgtagaccagtttccaagccagcttggataacggatttcctgtccccaggtcaatgtagcgtttaaggcatttgcctgagttaatgtcgatgcactgatacttaaaaacatcgccagtactaacataagctgtttccagcatttttttattttgtttaatcctttcatttctctacctcactttaagttaaaataaaaaagatatcattttaatatctaaataaatattaatttgtatctatatcgcctcccttcgtattattgcaataataacagcactaactcctgctaatacggcaaatagtttcaaatcaactgcatcacctgtttttactgcaattacaggtgaatgtttaggaacaatactgatatcataattcatgctgtttttgctttcattattaaaagcaggtacggatatcagtgttgatacgatattctcatatttattgatatctgttgcctgaagcagatagacacccttttctaactgatcaaatttgaccgttccatagtcattggtagtttttctagttccaactatattttttgaaacagtaatttttgaaatagtgtatgctgcatttttcatatcttctgccgtttctaaagtgtttaaatcaatctcaatatcctgcagatcattaataagcaaatactggccattgattatatcagctattttgataagttctaattctacgtttttaacactggtacccttttttccttcttcaagatttactgttatagatccgacttcgtctaaagcagaaacagcggttatactgataaaaaataaaaaaactgtgaatactgctgtaattaattttttacacatttttcacccctcgttttctaaaaaatagtatgcctgccactgaaaacagaacaggaataacatagaaaataatttctcttaatgacggcatactgcttttaattgatttcttttccttttcctcatatggaactcttttgccagttattacaagcctgttagtatttagcccgtaaggagtacaggtaatcagtgtcgctaaatcctgattatctataattgaataactgaccttatcaggcagtactacctctattttatttattttatatgctaaagtttcatcgagtactttaataaaaaaaagatcaccctttttaagttcgtctaatcgagtaaaaagtttgcttgacggcaagcctctatggccagttaaaacagtgtgggtattgttaccacctacaggcaaagaactgtcctctatatggccagctcccacgtttaatacatcactgtctgtaccatgatagataggcatatttacctttatttttggaatttctacagttcctattacaccatttccaaaatctaaaacattttcatattctaaccctgaatcctctggcagtcccttttcttttgaatacaggttatcattccattcatgagcttcgttcagcattaactgtttatttgctctgctcaactcactgacagaattgttatatgtatcgatctgatctgcctgttctatggactctatataattagaaataacaggatagctcacaagagccagtcctgttataaaaattaaaatatcttttttaagaaatttgagaattctcatttttttcattttttcttcttctggcaagtacagttaccatcaccgcagtacccgttgcaactaataataaagtggccatactacctgttgcaggaagtttagacccgactttgtttacaaccttgatattaaatgtacctgtatctacatcagttgatagtgttttgtcatattgactatatgcgcctgtataaaattctttaaaacttgctgttgctgctaatttctgtaatgtctttgctgttgcaccatcgcccttaacataatttaatctgttgtcagctccataagttgcttttacatcgatttttatagggtcttttaataaacggtaaccgtctggcgccttagtttctttcaaataatatgtctgactgtctaaacctatgatattgaaaacaccatttgaatcagacaccatttcaaccgcttcacttggtgcagtatcacctgttacgctgtctcgattgattacagtataaccgtctccgccgcttgcttttttaacatatacctctttagtacagtcctcatcactgtataatctaaatttagcaccttccagctttctttcttgagtctggtcattgaccttaataccgtccattctaaatgtaaatgccactactgtatcccaaggtgttaaccctgttttaccagtcccgttactgtcgggatcgttagaatattccagtcttacatcattttcgaaacctgctctaccagtatcagcctgagcagattcatttaaagtggcattatattctacaacaattttttgaccatacagcttctctgtttctggatttgctcccgcttcagatgcataaaaatatttattaattgtcgcttttaaatctgtaatctggatctggaatgtttctccagttaagccagttgttacaactttataatctgtatcttttacaagcgtcttgttcccgactttgacaactacactatccttattgaatgttaactggctgtccatgcggtcatgcattgcaaaatagtaatttgcatacccgttcatatctggcgcatatgtcaaatagcggtaaggcacggtctgtccaatctcataatctcctacatcattccatccgtctttatctgttccgactgtcttttgattatcatcttctaaaatctgtttttgaattacaggaaaatctgattttatatcgattgcgatatctggattagcagtatttaccatgatcatagatgcagcactgtgcgttccattaacactcgtaatttcatcgattatataccacccgtatgcaacatctaatgtataactgtctgttgctgtagatggaactgttaaaacctgagtagggtcggctttatcttcaactaacatatttctcagactctcaacaaaatatctaaaattagaatatgcagtctcgtttttctgtgtctgtgaaacatcattgatcacctgattgttatttaacgtttgaatataatctatgattgcatattctgtatcttttccagtaaccttctttaacgatttttcatatgcagggttcattgtatagttaatactttccattcctgcactgttttgagcatcaaagatacggtaaatattaaatttcttccctgccagactttgagtaactccattatctcctacattggcattaatagttatatgtcctgttccttcagcatttagtttcgtaaaaattccgtttccagtatttccactgttgactaaatttgctactgttcctgctgtcgttaaagacagtacacaagctaaagcggttatacctaattttttaattttattcatcattgttttttccccttttgatcgaaattaataaacataaaatacctgcccctgttaaaacaatcgtcataggacttccagttgcaggaagaatagatcctcgactgtttataactgtcaaattgccagtatataagccattttctaacgttaagctgttatttttgtcatcttccttaatctctttgtcattaacaaaaaaagtgaacttcccgttcacattttttaatgatattttaattggatcttccagcagacgataacctgcaggtgcttttgtttcttttaaataaaaatcaccaacagaaatccgatcaaaattcaattgaccgttcttgtcggtttttcctttttctatttccttcgtacattccatatcagaatataagctaaattcagcattctctaatactttactgttatcattcttctttgtaattcgaagattgcatatatctatttcatttttaacagtaatggtcattgtaccatgaaacggcacattaaaagtaccatcttctacagtaccattcagatctgaaacactgaatgcccccttctcatcaacataaaaataatatttggtattatttaatttataagagtcaggcgcttttgtttcctgaagataataggttttctgtcttgataaataaaaaacagcaatattgccattcttatctgttttatatgttcctactttctttttatctgtaacgttgtataaatcaaattcagcattttcaagttttttacccgaatccttatcaactttataaacatttataaaagtaggatagttgtttatttcccatgtcacatccaatcccatatgcagtttagaatcagttttatcattagttatagtaaaatcgtatgtactgccatcatcacggaaaccatctggtaccatagactcctttagggtgtattcccctaaattaagattatccagttcaccataaccgttttcatctgttgtaagatttcctactacttcgccctgcctatatataacagttccctgtggtgttcttatatcgtttctggcaatcacatcaaatgttgcgtttgctaatttttcacctgcatgataatctaatttatcaacagatattttacccattatcctattgtttacaacattgatcgttgtatcacttggccaaaaattaactgcataagaataaatattttgctgtacagcagtattataatagatatgaatcacgtactgtccactttcaggcatctgcttatttgcacgccataccccgtcactttcttttgcaaggtgaacccaatcaatatcatcttgtcccccattaatcgaccatgtaggaaatttaatctctgttacactatctggtacaccatccacctcatattttatgtaatggttgtccgcaagtgtagacgataattttacatttacttctttaccttcaatttctgctgtaaaaacacttctgtcgatatagccgtctaatgtaaattcctgctcgtatctcgaagaagctgtatatccatttggtactgtttcctctaccttaaatttaccttcattcagatctgttttttctaaaaaatcactctcatataatttattggtagaattatatgaaaactctcttaatttttcatattgactagttgtcttattccactgtaataaatcaaatttagcgttagaaatgttttcaccaaaattgtcagttttattaatacctatttgactgccatttaaccaactgacattaaaacttaatgttcttgggtcactagttacagaaagtgtcgcctctgcttggtatccaccccctggcattatagccaaaggagcatacattgtagaattattaccagctaattcaccgctactataatcttccattttttgtaacggtgctgacaaataaaaagtatcaccaccattaattgaaactgttccactgctaactgtcccttttgttagattatgaagctctaccccttcctgtaaaggaatgtctattgtcacattgctttcagcattaaatgtattgttttcagttctctgagtacttgtgcctgaatcataatatgcacttaaattagttttagttaaattaaatgtttttgtcggtactggcatggactgaatctgttcatatctccatttcaatccaattccattagccaataaatcatcccatgacttaccaccataaatatctcctgagtaagcataactagccataatatgcgtatacagatatttattagtgtcattggtaacttggtcatctttaaaaacatctcctggtccgccataaccatagtaaagaactttcaatagtgcatcattatttctaataacataaggtgcatattgtccttgtggtggcgtgttttttgaagattcgagacaatacgcaagtgatccattaatataacacattttagtactccaattgcctagccaactaggataataaatttcctgtccccatgtaaatgaaatactgctttgtgccatcactggaaatactgatgacaaaatacatatgatagaaagaaacgtaataataaagcatttaatttttcttgtcattttattttccttccttcttcattatttttctatataactaacaaggatttctacaataaaatttcattttattccctccaaaaataaaaagcaattcaacgaattgctttttatatatatttatcccaatattttacatctgtggcatcacttggaactctccacgattctaatggatcgccctcataacagatatatccatcctcaaaagttgaatctccccacttataagtcactgtacgccaaacttttctttttactggctgagtattttctcccgttgatccagaatttcctccagtatttcctgagcttgatccactcccagaacttccacctgaattaccactatttcctccagaactgttaccaccagatgttcctccatttgaaggcttgttagaaccactaccagatgatcctgagcttcctccagtagaacctgaaggtttgcttccagaactattagagctgctatttgaattatttccactagatactactttatctccagatgaatccacttttttcttaacagtattttttactgtttttgttccgtcagcattagttactgtctcttggactacaacttcgtcttcggcaattgctggtggcgcaattactgtaacctttacatctttttcagctttatttccatttgcatcttcaatactagcttttacagtatatttagcaggtacattaatatctactgtactgtaatcaactgtcaattcatttattgttgctaaatcagtcgctataatcaatgatttaaaatcaaatgtagtcaaatctgtcccttgaagaatttctatattttctggtactgtcatttctggggcagttgtatctttcacaactaccttaactgttttagtttcatctttatatgttaaatttactttataatctcctactttagcaaacccacgatctttttcttcagtagtaccatcctcgttagtcactgtttcaatatcattttttatatctgtttttattttaaggttttttttcaaatattccttatcttctttatttaatcctttagtatcaactaaagtatcaaaatcagctttgaattcttttccgtattcaagattaatcgtatttttctttagttgtaattttggtgaagtgtctcttgtagcatatacaattcctccgccacatcccaagacaattaaacctgtaagacatcccgcaatgagcctgttctttttggtatttaaatacttatcaataatatcttttctgatgtccatactttatccctccatctaaattttataatttattactctataattcaaattttagtataaactatttgaattttgatatattcctattaaagtatcaccccgcagtgactgtaatatacgaatcatattcacctgactcacacttatacatcctgctgtagaaccgccagttgagcagtgtaaaaagatagcactacccgcacctggtgtacaagcagtattataatttacagcaatagcatatttatatgctgttggataaccaattaaatgctcagcactgctccattgaattccagtctgactagcatcaactaatttattgtaatatggactgtttacatcatctacccaataatgattgttgttgacctgtaaccatcctctagaagtacctggatttcctgctacaccaaacgcttgaccaaaactatagattcccgtaggtgttttcccatcaccttcacgtttgttgctagttataccatttttccccactcttgctgaacagcttaatgtttctgtccaaataccgttacgcttagtatgcagtgttaacgttgcatagcttccaccgtttccaacaactgttattgcctgtgtagtttgtctcgaaattgacatattagcaacaaaactatgattcactccagaattggaagatgaattagaactattgctgcttgatgaacctgtagatccttttttatttgtactgcttcctttactggaattagaactaattttagtatttgctgtatcgtcttgagccgtcgctttatctcttaatgtattgcgaatagattttgttccatcctcattagttactgtttctgttactaattcctgattttcatttggagtttctgttatattaactgttaattctttagtagtttcattactagaagtatccttagcagtaacttttaatacatatgttcctactgtactactgttaattgcactgctgtcgtatcctgcctctacaggcgatagatctgttgcattaaataaattaagaccgccgaaatcataggtatttagatcagtacctttaactatatcaatatcacgaaattctgtattaagttctggtgcagtcgtatcagcaactttaacctttttaacaagtgaatcatcattaaagatcattgttatcttatactctccaactgctggataatctttaccgtcctcatatttaaaattagattttatacttaaaccattttttaatatttttttatctttatcatccataccttctgtattcaataatttcatgccgttaacagaatatttatctccatattctaatttaatagttttactattacttagaacgaaatcgggtaaattatcttttgttaaagcatatatacccagtgtactagctaaaatcactgccactacactaattcctgcgataatctttttatttcttgtatctaaataatttaataacatttttttcattgtgctttttctccctgttttaccttttcaacatcctcactataggacttctctattccacataaatagtcaatcgatactttatatagcaaagcaagctgcattagcttatcgattggtggcactcggattcctaattcatataatgataatgtagatcgatttatgcctgttaactcttctacttcgaactgtgttaactttctttttatcctcaactgctttaagcgttctcctatttccataatgaatgttcctcccgtgcaaatcatataaaatctattgctactttaggtagcattgctacaaagagaaacaaaaatagtagtattaaaactaattcaattcaattgttctcatctgtattcctcctgatatttcctttacaatttaatgatatcaataaagaaaaaaggttagggcacaattttttttacgtatataactgcaataaaaaaagcagtcattggtcgaaataccaataaatgctctcaatttttggatacaattttaactatactaattttaacatatcctttgtttcaaaaaggcacaattttttttcaaaaaagtgaatattttttgaataatattcacactatttaaaaaaaactgatttcatcagttttttttcttttgttaaatcattatattagtaatacaaatactcattttctactaaaaatatctactaaaaatatttcttgactataaaaaagaggcaatttgcctctttttcaagttattaataacaactttccattaaaacattatcaatccaagtcttatcgattgtttcatactgctgtatttttcacttcacttcaataaaatagttaaaactcttttcatttttattcttccccgattccattataatacaataaaaattaaccaaaaagaaagagtgatgagaactccactctttcttgtataaaggaaaaaaatacaggtaatcatgcaaacatcgcttttcgacagacagttttctaatccaaaagtatactattatttaattgtctacatttattacctgcaaacacatcttagcatatttgcatattagagagggcacaattttttttgcgttttatcttacaaccattacttacaaaaggcagtgtattacatgcatcttgtacatttatacatcgacatcaatacttggaacatattctttatcctgtataattaatacgatttcttcaatagttaatttaccctctctatttaaatctgcaagtaaatctacagcctcttcctttttgtcagcagttatagtttttcacagccatatattatttaacaaaatcccctcgaacaagtcattgtgatagttaatccaaaaagttgactgtttccgtttgagggctttcttcaatgttgctaaaataacattaacttaaaaaaattgttataattattatttttatttagatacatataataaacagtgatgtaaaagtatcttactctctttgccttctctatctgtacacagtttccttcaggcactggaagatcatttatcattctttgaatttcttcacacaattttctatagcacaccactctatcttctttttccatcaaattttcctctttatcattcattgtgctgtttaatattatattcttattcaaccacctgctctttaaaatcattatttagatactcatagttttccatttccaacagtttctcaatttttttattaatggactcatctgctctttctttaacaaaatcaaaaaatgtataataactgtcttttaggtacgattcacaaaaattctttgcaactatcattcgatgaagttctgaaatagaaatttcaaattcattcaaaatttctgttaaattctctacccttctaagctgatgatcgcttacatccttaatctcttgataattttttttgaatttaagtaaaaactcttccgcttttctatcaccgtaattatctttatagtatttttctatcttttttgtcccgacttcaactgttaaaagtaaactttgtttgccgaaaattaattcatattcaaaatcctccaacaaaatgtctatttcatttttcatttatttcaccaccaatctattaactgcttatagtaaatatattcacataaaaaatatgatttttttctcacaaaagttcgagttcattatcattttctatttccttctctaacttatttatagcatttttctctatatattctttaacaatttcttttgaaagcttgtcacccctgcttactggaactaaaaagtatttgatcattttatcgacttgtactttaacaaattgactgccatcttcatcactttctattccacctaacaaatcaataagatccatgtatttatcataagatagaatattatctgatataaaagtatcttttttacattcattcaacataaaattgtcatcatagttattattaaaaataagaactaatctctgcgcctgctgtttataattatcaggtaaaaagatagagatttcatcatcattaagataatcattaatctcctggactatttcttttctttttttatatttagaaatattttctctgatatctttcatttcatgatgagtaattcctaatacactttttaacacaactgctaatttgaaatactcactatttacgacattttccatttttacctccttctgcaaagtaaaaaagaggcaaaatgcctcttttttaaattatcatttccgtcacatcttcttctaaccaaatttttttgtcattattctcacacagctctaaagattcataactgttttgtaaattatctgtattatttatttcagtgtatttttcttgacgatcccctacaatagaataatattcattctcacctatcacaatatgatcaaggacttctatttctaaaatgcgccctcccttgattaataaatttgtcacgtcaatatcctcctgacttggagtacagtcaccagaaggatggttgtgtataatcattaccctatttgctcctgatagtagagctgatttaaagacactttttggatcaactattcccatatttgcacttcctatcgagcatacatgagcattaataattttatttttactattcatatttaaggtcattaaaatttctcgatctaaaaactttaattcatttgctaaaacttcgacagcatccagcggtgttcttatactcttttcacataaaaactctctttccttaactaatctgattccaacaacatcaatactgttcatttgctctcttcaccttttttattccattttcatctataacaatctcctcatcgtcctttatattatctatcagttcctttaaaatactgtaactaatttttttcatcctgttctccttgttataattctctctcattttcatcttcttcagcatagttttcacgagagattgatgtatttttcatcaagttcctcgattatatattcatgcttcacatttattagctccttctttataaaatagtactgtatgtaaaaaagaggcagtttgcctcttttttacataacttaatcataattccatatcttcatcctgttcattatcaacagtgatattaaaatctaaattcaaaagctgcttacatagatcagtgtatatgtcctgctcatttaaacaggtttcaaacaggtacgtcctgtctctgtcatattcttttaatccacgtaaataatacggcttgtccctatcaagaataataaaaggaacaatattattttttaaacattccttgaacatgatcgcacgcccaacacgaccattgccatcaccaaacggatgaattctctcaaagcgtaaatggaagtcaacaatatcttccaatgttactttgcctagcctgttatactcttcaatgagtacgtctatatctctttcaacttcgtctggttttgaggttttaataacatttaccagtccaattacattgggatggattttaaattctcctacattatatctgggatttgattcatcagaagttcccttttttagaattttattcatttcaataatcatatctttatttaacctatcatcaatatgatccaagatgaaatcaaagagtttaaaatgatttactgtttctgtaatatcatctactctgactaccttctcgtctttatcaggaaaaaaagaattagtttcaaatatcatttcagtctgttcttctgttaatcgacttccttctattttatttgaattatatgcaaacaatacctgtgaaacatgataaatgttaccaggaaattttgattgtttttgttctataagttccttttttaatttttctatatctgtcatttccaatctcctatacttatgttataagtatatcactttaaacataaaatgtaacacaaattgattattcctataaaaaagacaaaatatatcttttcctacatctccatgttatcattgctttctctatcttctaattctgactgttcccttaaaattctattttcttcataataaacagttacacgtaaaaggtcgtttaaatccttaattttaagatttggttttccatcatagccgtatattttttatttctagtgaaactgtattaccattatcgttgaacaccccttcattgtcataccatttctttattttattacccgctatcacaccagcatcatctaaatctggcataatttctatttcttctaaattttttagagcaggattattctttaaattatatttaagtgtgttaagcatcgtacctactccgctgcacattaatacatgagcagttagattgtttctatttagagaaatatagctaagtccatcaattacgctttctgtaactacaattttttttattccttcaaaattctgataaaatagcccgttatttttaaatgaccctttacagtctatatgaaattttgaattgcccgtacctctgcggattgcaaaaactggttttttttcttttatattatttacatcatatccaacaaataccacattgtgatatatatcttcatatacaatgccatcctctattagtttgctaacaagtgaatcgcttagttttctttcattggtcagataatgaattgctctctcattattatcgtttttttgtgttaatacaagtccttggctgatatgactttcgtccatagaaaaatcatacaaatactgctcaatttcatttggatttcttgaataaaagtactctaaaagtatattaattgcatcatatgttgaagtattagtgtattcactgtaaaactcaattacatttaaaggtactgacccgcaacgagcattccagtatactttgttttttaaaatatcaaataccatcgaactatgttcaactggtttaagatatcgttgacttctactgcttttatgaacagtaagattaaaaacatttgttgcaacttctatacatgtaagctccttgagcatttcacttacgatagttttacggtattctttttcagaattgcttaatatttttacattagtcatttttattcactcctataaatataaaaagaggcaaattgcctctttttatataattccattttgttacatactttctttaataactttaactatattttctataattctctttcatctacaaattcatattctgtatatctaaaatgcgtttcgaattcatcacttaaatatgattttcgaatttcatgattcaatgtttgaaggtgattaggataatgttcatatatatccagcaacatttccctattttctatgataagtgccttttcatctgaatttattcttaggttatcaataaaatcatacaaagcgctccatctatatccatgatggaatttttcagactcttctggatgttcaataataatccgctctatgccagttttattattcttttcaaaaaagctttcgaaacaatactgctcatctagagtaacaaataagcctaatatacatttaaaattatcatcatttaacagtttcttaaattcagtaccaatatttttttcctgcttcaaagacaatttaatattattctttttgagatactccttaaaataattatttattgcactatcaaaatcttcttgagatgcaagctttgtatatttatcttttcccaatttcacgtttataaattccatatttgctttgtttctgtaataatcgttgatccagtcgtgacatcctaattgttccatgatttttactggtaaaacaatttgagaattaatatatatttttatagggctaaaaattcttgacattaataaattattaggattttcaattgctggcgtaaccgtagtcgctccatctgttaaagccctataaatatggcagtatatatttttttctaataattctttatatgaatcataataactggtaaattcgcattcaccatactcatcataattgggtgatacaatagtatgaagctcaattttaaatttctgattgtccattgtttcttcaatccagcactctaagaaaatatcatgctttttaaacatactgctgttatttctgctgtagaaatcgtttgcgattttttttgcctccttttcggttaatatgtttgtcatttttttgaatttgaacatttcttttatttccttctttctttgttaaaatataaaaaagaggcaatttgcctcttttaagatttgctataacacaattctcctttattgcataattttaactatactaatcttagcatatcctttgtttcaaaaaggcacaattttttttcaaaaaagtgaacattttttgaataatattcactttattttatttacctttttctgttctttagtaagttttgtcgtaacaaaacttactctttttaaatttctagttcgatttcctcagcttcattttcctctaatacaactccattgttattgtcagttaaaagattagtgatctctttttgtctttgtctcaaactaagcagttcttcctgtgattcaaattttttatttataatatcatcaagttttgcataattttctttcatgttattaatttgtataaaatacttttcataatctttttttatttcaaaaatttttctaatcattctcccaacattaactctgcctactgcgtttaacaatccagcattgtacagatagttattcgctcctttaaaacagatattccaaccatttccaacattataatcaagaataaattcaaaacccatcatttttccaataggaattgaatttttttctttattcatgtcagataatctgatgataaaatcaccatactcctttaaatcggtaaagactttgtctttatattcaactttaaaatcaatatccattttctcattaatcatttcatattcaaaattgatatgctttttaaatacagaatagtctttacttatacgatcgaatttcatttctaaattttttattttttcaggcatattacgcttatcatcctgtgactttctaattgcttttctgtgtcttgccagactggattcaagagtttttaagcgtgtgtctacttcaagtttttctcttattaaaggattaccgcttgcaatagctttaatttctgcatacgaaaaagttgcctttgtatcttcttcaatttctcgtgcacatccactgccttcaagcagttgattcatatacgttgacttggtttctatcagttgccatgagtaggcatcgaatgatttttttgttgcatatctaaattcatatacttcattattcatatttccctgcctaaagacccgtccatttcgttgtgcaatatctgaggctctccatggtacgtcaacatgatgaattgcaatcattctttgctgaacgtttgtacctgcaccaagttttgctgttgaaccaatcagtactctgacttctcctttatttacatctctataaagtttttctttttttagagttgttttatagtcatgtataaatgcaatttcttcatcatttacacctaatttaattaaattgtttttgatttcgtcatatacattgaattgtgatttaggagtagaagaatcacaaaaaacgagttgagtagctttttgatccctgtactcatcatatattctatatatctgttctgaaattacagttaatttattatctgaagtcaaaccgtagctttcgtcaataagacgcagatctattgatgccttcttgctgtcactggttacctttaacatattatcttcatatggagcaactgccgaattatgtattgcttcagttctttcgactacatttgcaatataatcctccaactctggacttggttctattgaaactacctttgccttatcgcccgcatgttttggcggtatagccctttttctttgcagtttagaattttcaagtgcattattcagcatcgactctgtttgaatttctgcaacctctctaaatgaattcattaattcaggtatattaaaaaatttgttaaacctctgtctggtttgaaatccgcttccgtctactgatacctctagagaagtaacaactttaccaaatgtttttgcccaggcatcaaaattatgaatatttaatctttctaattcctcttcctgtaaatatctctgcattgtaaacagctcagccatagtatttgtaattggcgtacctgttgcaaagcagacattaccaccgcttttttgtataaatttgcatttcatatacatatcactggctttttgacttctagcttgaggaacacctgcgatatttgacatagcagtatacgtatataaattcttaaattcgtgtgcctcgtcaacaaacatataatctactcctaatttatcgaaagtgatcccctgatctcttttaatatctgtaagcttctttacatttttttctacggcctttttagaacgttcgagcaacttaacaacagcagtattttgatggcttccatttgcttttgcttcttcaattgcagttactaatttatctatttcttcattcaaaaaatttaactgtatctcattatccataggaatcagtttaaaagacgagtgacccattattactgcatcataattattcactgccatcttatttactatatctgctcttttctttgtgccaaaatcattagtagaaattgccaaaatatttgcctgtggatatagtgtcataaattcattacgccattgtccaatcaaatggttaggtacaacatacagcagtttatttcttttacccattcttttcatttccataccacttgcaatcatttcgaatgttttgccagctcccacctgttgtgataaaagagtatttttgccatagattattcttgcaatagcatttttttgatattcttccatctgaaaactgttattcatttcaggaaagcttaaaaattctccattataaattcttggccttataacattaaacagtcgattatactcatcttcaatctctctgcagtatttctcattgtcaaatacgaactcaacaaatgtattttccaactgtgacgacaattctcttgcctgtccagtcctttcgctgttaatttcactttttgtttttacgatgccaccttcatttatttcctcccaatagtttttcaacgttgggattctggaattcaaaacatcgttcagcaggtcaaagccattatatcttggctgtcttttaattacaccgtcagtatcaatattttcagataaaggtactccccattcatcttcaataaaactattcccaaagaatctatactcgtaataatccattgcaaactgtcctgtttcattaataaagcttattgtcagtgacttggaatcatacatcatattttcaaatcgaaaaaggtagcaggcgaaatcctcatatatgtgtgttggtatatatggcgcacccaattgaaaagttatatcagtaatagtcaacggttcaggcataacgttattcaatgcattgatatttttttcatatctgtcaattaaattattttctcttataaagtctattttttctagaatatttccagaaagatactcactttctaattgccacctttcttccttaggatcataaaataccatagccgatgagtgcatttccttttcaatgctttcaatacttttatcataaataatgctcatataatttaaatctaacatacctttaaaatttaatgatgcagaaattgcatcctgtatactttcaacatgttttatttcaacaacgggattgatagttctgattttaaaaatatctgattttatatatgtatttgcctctacgcctttagattccagatttaaaataagatactgccgtggatctctttctaaaagattcttaatagccctggaattgatataattatgcttttttataaaactgtcatatgctatatttaatgaatttcttaaagcaagatatgccttctcatcgaatttgttagatgactgtatactaactgtttcttcagcaagctctgcaattttaataagttcctttctacgaagattatttaactcattatcgtgtaccagtatgcagtaattttcatctctaatatatacattatcatctttcacaaaataagtattcagtttcagattaaatgattcattatcaatcgcaatagtatcagctacagtttcctgaacagcttcataatatatatttgaaggcaggactgccattgctctagcaaaatgttcatcaagagaaattccatcataattgactctcattacatgttgtccaaatctgcctatttcgtcctttggtgtaccaaatatcatatcaggattatcaataaaatatttattgatttttagttcagatgaaaaatattcagactgcatccagttttcaatcttattataaggctgtttattactgtttttttgcaaaataataacatcagtagtggttgtagtattagcaccattaatattaaatatattagtcggcagtcttaccgctccaataaaatctgctctcaaattaatgtactccagtatcctggatgaaccgtccatcgtatttgtcgatgttataaaacagataatccctccttctcttactttagataaagatttggcaaaaaaatagttatggatagcaaatccataactgtttaaatttatgtcgtgtacctgataatttccaaaaggtacatttgaaatagccagatcataaaaattatcaggtacatttgcctcctcaaaacccgatatttcaacctttgcagacggataaagcatttgtgcaataccgcccgttatagtatcaagttcaacgccgtgaatagaagattcattaagcatatcataaggcatcattccaataaaatttcctgtaccaagactcggctccaatatattacctttcttaaatcccaactgatctaatatttcatatatcttttcaacaattactaaaggtgtataaaaactcgataatgttgaagcacgtgcattttgatattctttaattgttaacatctgttttaaaatatttctttcggcagcatattttatatcatcttcattgaaaacatgtggcaatccaccccagcctgaatatttagaaagaacttcctgctgttcaggtaaaatacttaaattactgctagactgtaaatttctaagtacttttatcgcatttatattgttattcagtttttcccttaaagataaatgttcatcatgttctacagttaatctaaaatctctgtttaaatgtaagttggtcgattcttgataagtggctgattcatcaaccattccatcatcttcttttgaaccatgtcctgtttcattttcgacagtgacagcttctgaatgaacgaaagttccagtggctctggatactccactgccactaattttttgatctgctgataagctatctctgaagctttcatcaagtcctcgatttctgtgttgattgtcttgtttattatcaattctaaatacatttgcgggttcttttctttcaaaatattcatcatcctgtccttcgacatcccccatgaggtaatcatcaaatattgagatttgttcccattttctttcaccaatttgtccattttttcttcctcccatacttttttttggcatctattctttcctccattatatcatattcaaaaaaaagaggcatattgcctctttttaaacacacaaatcatatgtattggtttcttcatcaaattctgtataaatttctttttttgattctatcagcagttcctgtaattcaccttttacttctatatattctgaaatttcctcagcaccgtttagagcgctaaatataatttcaggatttttcttaatctgcttataccaaaattgtacatatgcagtatgattatctatcttttcctgctttatttctattccaatatcagcacataaaaaagatgaagctatctcagcatataattcttcaaatgcatatctttcattatttgtttttaaattagggtaacttcttcctaatcggttttctttcatcgttgaatgacagcactcgtgcaataccgctgatacaaactcgtattcatcatcaaaactacctttagctggaattaagatcatgtcatttactggtttataaacagggcactcacataaaaaattttcaacaatactaagattagcatttttgcaatatctatcaataaatctgcaggccaaatcatttacatcaatatgaatgtctttttcttctatcgtgtagggttctattccttcaataagtgaagcattaaaaacataaaatactttaaccgaccacttaaagcgttcatacttttcctgccgactgagattttcttctctgacaattttatctacatcgctaatatttaagtatttttttgtctccatatcatataaagaacatttttccaatggaacacccttgccctttgcattatttaatttataatttgctgctttaatttgtgaaaacgtcatccatcgtggatcgttataattattctttgcaacagcattataaagaataaggcgatttattcctctgtattgtgttttggtaacaggattatagtttttgactgtagaccacccctgcttccatggtatgatttctttttccagtgattctatataagaatcaactaacgcctgccttgccttgctcatctctcttttcatgattactcatctccaaaatctagtggataaaataattcttctattacatcttcgtcacttacttctgtctcttcatcgcatataaaaatttgtacttttttcatcttctttctcctataattccacttcattttcatcttgaatttcatcattattcatctccaaaatttctgtcataaatatctcatcccaatactctaaaatgttttcatagcacttatccgaaatgtatttaaaatccatttgttttacaagttctacaaaagtaatcatagaacagtcaattggaatcatattactattctttgcagtataagcaattccatcctgactatcaattatttctggcgcatccacaatcaaaccatctttataacctctaaaatatgaatactccagtaacacttcagcttttctggaattaccgtattcgtctgtatacaaatatggttcaaactcctttatttttgtttcacagtaatttttaaaaatatccattgctttgccagttttatattgatcactctcataatataattcactaacaatttgctctactataggactatcaataacaacatgccaatcatctttaataacttcaatttgattttcaatcgttttttttgcatgttcatacccataacattctaaaatacatgtttcagtgttctttgaatttcttaatttaacacaaataatctcatgattttctttcttcatttcttcttctccctttctattttctttatccagtaaaaaagaggcactttgcctcttttcaaaatacaaataatactttaataatttatagattgatttcattttcattgtcatcaaaaatttttctttgttttcagattttccaaaaccaggaactgaatgtactttttaataaataaagccttcgagtattttcttctccaaaacgatgaacctgccatatatttgatgtaaatatagccaaaataacatgttagaaataattaattaagtattttagtttattgtgaattataaaaactgttctaattcatctaaagcaatttcctgattaattctttcaacctcagtctcattctttaaatattgtttctggttttctaaacgttctattacctcgtcaatataattatctagttcagcaggtgtaatcggttttatatatccaaaagcctttaaggaaagttcatcactatttggtgtagaaatttctattgaatccattagagcttgtgcaagtacatatccattagcacctttttgacataaaacttttattctgtcaggatctataattcccatattctggatcagtgacatagaatcaggatgttctcctataacaactaataacatcttcattctttgtctaatattaaaatgataagtattattttttaaatctcttagaaattcaaccgcactggtataatccataaaaattcaactccttttatatttctctatcatcatcaatatctttatccaaatgcaaatcttcatttgaaatagcttgttcagcaaaaatattattatgcagtattttaaaatcatttttcagttcatcaatagttccataaaataaaatattttttgaataatcatcgttttctataaaaattgatatttcatttgtttttgaattttgaataattgaaatatctttggttattgttgatatatgttttaaagtgggcaagggcagttgacctaaacactccatcattaaatcaaatggaagtgcatatgcgtaaatatccaataaaagcaatttactaaatactttgaattcatctaatagattcaatccatgcatacattctttaattgtatctagataagcagtatctttatcaacgatttcaaaactaataatatcattatcattaaaattagatagaattcgttttaaatctatattatttctataaataatttgggcaatatctttctttttccctgcaatgatattattattgatgtaataaactttatctgctatttgataattatcagcaaaatgactttttaaaaaattagaaacaaaataattttcatgtttaattatagtctctgtattatgcttattacttcctagagaagtaatacaaaattcatgattattgctattttcatacctatcccaaggccagtctcctgcgccaattccataaacgtggattttagtattatcatctaatacaatatctgttgcactatattctgtagtgtcgacatattcatcatctatccatgtaacagaaaaagtatcattaatttcattgtatttaaattctaattcatcaaatacttcatgcatttgttctactacattttttgtaaagtagggtattacatatcctttgaaagtgaaattttttaaagaataaccttcaaagcaaaaattatcatcttcaactgcaaaaaatccttttttagctcttttttgtatcatttttacaactccttagttttaagaaaaaagaggcattttgcctctttttacatttccatttcgtaattatcttcatttttataaattatattatattctttatacacattgtcatcattttctatttcattgtcagattttgatatactgatcttggataatgtttcatttaaattaattaattcattattcattggttctaattgtaataatttacttgatgttatatctttaatcattactataaactcttcctcagaataattgtttaaatcatttgtattatagtcagaaataagactctgatatagcatatttatatctttaatttgattatttttaaccattttacaaatatcttcttttaactgaatcccaatgttatgttttttagataatgtatttagctgttcttctaattcagctacagtgtcattatttttattgatttcatttaaattgtctgcaagtctttctctgtctttatttttttcctcccaccgccaaaaataatactttttttgctgaagtatttcattttcctgttttaataatgtattttcaatatataactcttttctacagttatttatctcacttatcttattattaataaattcgagatgattatcagtatctaactgttcaagacaattccaccacaatgtagaaatcgctttccttaaaggaaaatcatcagataaataagtatcgtatttttctaataaaatgtatctgttatgtatatcctgtattatgttatcctgattagattctaattgatataaaatatcaattctttcttgtaactgttctatttcttcattcagtacattttttgtatcaggaatctgcaaccaagctttttcaagttcataattgcaattttctttcaccttatcaggcaagttttcccagatagccatgaattgaagtgatttagataatctccattcatctacatcttcacctccatattgcccatactgatattgatcacatgcatcaaaatgtctatgaaatgcactattttcaacacaattgactattgcctctcttactttaatattttgtaactgttcatttgatatttgatttaaaatatgattaggaatattcatatctgtacttaaatgcataattatttcttcgattgaaagattgtcattacgtgacaattcattcacatagttggatattttattctcgctgttatatttatcgtttaaaaataaatataatttatcttccaaatcatcatatttattaatcaactttaaattatgaaaacttatatcagtatatggttcagcgaatatatcaccaaatctgtcacccccaggataattaataatcaaatcagtttgatttgttaaatgaataatatctcgacgatcataataaaaatcacttctttcatcaatattttcccaactgaattcattttcaggaaatttaatttttatatatgatattacatcgtcaattttgagttgttttgtttctttgataagattttcaattttagttttaattagttcattttccataacttttctccaaattatatttctaaatcataatcattttctaatttctcatatcctacagtactttcattggaatatgtaataggatttatatcaattatagtagcttttttatccagctgttcttctatattttttttcattagattaaaattttcttttgctaaatttcttttttcctgtgaggtattttgtatattttcaactccttcaataacgattgcatttctggacacattcaatgcagctacagctaaattaccgcttccagcaaactgatcaagaataacttcatatggaagcgatatataactgattatttcctctagcaactcgactggtttttcagcctgatgtactcttttagttatactttttggctgatagttaaactgcgtaggaagcatacttgatgttccgctcatgtaatgaacaactaaattattttcctctaataacgctttgacctgagatgaatccattccttttatatccagaccattatttaatgcagtttgaatgtttttctttgcattaagttttaatgatctgggttttccctttgaaaaaatcataacatcttcagtgttttttgattttcttccagtattagcgacagaatttccctttatccatggtactttcgcaaaatatttcaacccgcttttttttgccatttgttttatttcgtacagatactcatagttgatttctgattcctcgggtaaaaattcaactataaaagcaccatctttcagtactcgacttttctctttaaaatctttttcctcatatttaaaaagttcatattctgcaaaatttcgattaccgccttttaactgcttaggcagtttataaggatgatcagtgattatcccatcaatagaattatcttttatcattgataaatctctgccgtcaccattaattaaaagacattgatttgttgttccgtttatttggctctccaccttataaacgcctcgagaaacccttttgaagattcctctatctatgccttcatatattctcgccctaatactttcatcatttactctttttcctctaacttcttttaccagttcagtagcttcttttatggtaaaattgtcctgttcataaaaatagtcaaacagattcatttgaattgttgcttttttcattgaagattcttctaaacccattgattccacctactttccttaataatttcttaaaattaaagacaaaaaagaggcattctgcctctttgcataattttaactatactaattttagcataacctttgtttcaaaaaggcacaattttttttcaaaaaagtgaacattttttgaatattattcaactcttttactttacattaaaacaacagcacatatatttatcagcatgtgtattattactaccatcatcagattttcttttttatgataaataatattagtagcaacatagaaaatgaaataattaaacatacagataaatgctgttatatcaagcttaataacttcgcttgcacaatgtaaagaagcaaatagcaaccctatgatcaaagtcttaataatccagtgtttttttaaacaatcagtatttttaaaaagcacgtatttaaaaaatatttcttcaataaatggcaaaagtgcaatacttataatacccaggataacagggctgtctgtatatatatttttaattaaatcattattgtatgttgatgcagttatcattgattcattaatatgagttagaaaactattaaccattacaagagaaaatgaaataattgctagttttaaactgttatccataacatccatagaatcattcacaaacttatttttaaaataatcttttgaaataaaaatcattcctataaaagttatacatgtgactgtcaatcgaagatatactgataaatcatctggtacaacactaattaaaactgctccaattataaagtaaaacagtatgtatataattagcgctttgcataaaatactaaatccttttatcattgtataatttgtctccatataatttgctttcttttttgaaatcatgaacatgtctcctttttgtaattttataatttaatttatatatatttataataactatataaaaagcatagcatatctgttttacaaaaaaggcacaattttttttactatatttctcacaaaaaaagaggcaaactgcctcttttttatgattttatccttttttcatattctctttctaatattttgatacgaaataatacctttactaaccaaaatattgttaatcttccacctatttccttgtccagtattgcatcatttacatacatcacttattgcatcatataaagcatctatttttttaggagttaaaacaaatattcctttatttttccagaggttaaatgaataatagtcgcccatgtggggtttcaagttttttaaaataatctataaaatcttcgtctttcagcttgtctacattttttacaaagaaagaaaaataattattgcttgttattaatttgcttgctacaggtttattcatattaactatcctactgtaataatccatgcccctatataaagagggtaccgagcgtagtcaatacccttctcaacctggacttataaaatcattttatcgagtagaaatcaatctaaaaatctttaaataaaattcatgattgagaatatctagcaaaaataatttacaaggatgcaatattttcaaagcttcaggcaaatgcatataattgagcaattcctcatacgtgtaacattgacttttattagcttgttttacaatttccttatgtaaagcattaataaattttttatatctcgttttattaacaagatgtttaattacaattaataatgcaaataaatcttatcgcccttgaattagttcccattttgtgttttgttaagtttaaaatggctgtgatatggtgttatagatatattgattacaccttgaacaaaattaaaaaataattcatcatgtgcacatagatttcttgcaacaacaagtaactggagataagtatgtaattttgaagctcttttattttgaacattaacagtaaaaatagatttagcaatatagtctttatcactcggtttcactattccatataaatttctaatttattcaaatgtaaagaccttcacagcaccccgcagtagaatttatccatgatttattttatagtgaattattgcatcattctttccccatagttatgtaattgatttctcaatttgttaattgtttcatctcaatgcttattattttgatcaaaattatttgcagctaaatattcatcactacttatcccataatgttgaataatttcataggcaattgtaaaactcaaaaacgaaaaggaccattaggtccttttcgtgactagattaattgttttcttttcttcttttcatgaagtaaagaattgatgataatgaaagtaatgaagttaaggcaaatggtaatacatttactttgtctcctgtagcaacatctccttttacagatggtgttacttgaccaggttttgatagattagtttgacttccatcttcaactttaatttcattcttttctaatttattaattgcatcatttaaagatgtaattaaaacttttaattcactgtttgacatatctgcagttgcagcttttccagcagtgattgctttttgtaagttttcataactttctgttgtatagtctttagcttcatatccattagctttatttaataaatcttgtaagctatcgtatgtataaatatttactaaatcactacaagtatttaataaatcagcgtatgcttgatcaatgtcttcttgagttggttcagattcatctaatacatcatttgcattttctaatgcattttcaaaatctaaccatgaatcagctgtataatcagatgaagttaatacacttactgtatctactaattcttttaatgtagttttgttagcttttaaaattaaacgcatttttgcatcatttaacgttttaatcataacttctacatcatttgcatctggattttcactatttaataatgcttcagcttcttcgataatatcatttaagttatctacagatactttagaataatcttttgtatcaatagcttttgctgcatcaatagcatcttttaatccttcagtatttacaacaacagtaccatcatggaatttgatttcagctgctgaagcaaatccaccaactgattctaagaattgaattcttattccatcaacatcataagcttgatcaaagatgatttgtttttcagttgcatcatttttaagatttccagttgcaatttgtgtccattcattagaacctgcttttttagcagtaattgcatatttagttaagataccattagaacctgtttgtcttggtaaatatgaaattccacttacacttgaagtgtttttaaagttaaattctaagatatgtttagttgttgtatcattccatggtgaatggaacatagttcctggatttccatctaatgctttatcaatactacttgatgcatcttgagatggtgatttaccagtaattaatgatgaatcaatgaagtttacattagttgcattagataattttaatgaagctaatgcattagctaaagctaattcatatccatctactgtatcttgcatagatacaggcaaaccatatttaacattgttgattgcagcttgtaacatagctacactatcatctgtatagttacttaatgcagtttcatcaattaattttaagtatttttctactcttgaataattagcttttgtatattctacatcttttaatgcattatttaaggcatttaaagcattagtgatttcttcttgagtaggattaaatttatttaatactgcttgtccattattaattaatgattgtaaatttggatttttatctactaatttagaagcaataactaaagcgttatctaattccatagtagaattataagtatcatttacaccaacacgtacatcatcaacatatccaacaaatgcatttgtttcactaccaattctagcaagtggtaacattgtagttgcatgtaatggtttatagtttccagttaaatcagccatttcattagatgttttatctttagctggatcaatagttgatactaattttccattaacatataattcagtaacatcttttctatttttgaattctaattcaacccattcatttactggtaagatgtaattaaatgagtaatcatggttttctctagagaaaccaactttacctgtatccttttgtacagctttgatacttccataatctgattcaaataaaatttgttcatcaatagaagcacttgttctttttactttaacacgtaaatcattacctaaaccagcagtttccaaatcagttgttacataactttctttaccagttaattgtaaagcttgtttaccatcaacagttttaacttctgcattttttaaagtattaaatgtttcatgtaaaataacaccatctttattttctacatcataaccgaagtttgttcctggagcatctcctaattgtttagcgacactttcagcaccagctaaatctaaagattgtttaccccataatttagcagcaaataatggtaatccttttacaatacgatcataaatatcatattcactcataccattttctaagtagtcagtcatatcattccatactgcgaaggctccacctatcatttgtttatcacctgcaggtacagtaacaccaccgatagtattgatatttaaattatacattgttccattatttaaataatcatagtaatatccagcagctggtacgatgtagtagtttccatcattacagttaattaaatcgaaaccttcttcatacatcttatccatatttgcccaaccaaagttccataagttcatttgaacatctttgcttgtaacttcaacatcacctttgatagatgataaacttccccaaatccgagcagttctacctgtatcttgaacatattttaacatatcattacagaatttacggtatgcagtaccatctgcactgtattcatcagcaccaacatgtactgttgtttgagcatcaaatactggatcttgacctttcatatattcatcaaagattccttgtacgaattctactgattcatcatattttgtagttaagtttaagtgatcattttgtctaccgctagtaccatgtcttaaatcaggtctaactttagtaagagctaatgaatgtgctggtgtatcaatttcaggtacgatatttacaccataatctctagattctttaatatagtttttaaattcttcttttgtataccaaacatctttagcagttaaatcagctttatttaaaccaccatttccaccttctttaacatcagattcaagacggaatgcagaataagcatcaaaaacatttttatcatgtttagtataatcttctaaaggaattaagttgtcatttaaatgaatttgtaagtcattcatcttataccatgacatttctttagttaattgttttaagtaatccattgtaaatgttttacgaccaacatctaaaataaatcctctaactttatataaaggataatctcttgcgatacctttattaatatattcattaccgccttgttttaaagattgtaaaatagtacgagttgcccagaaagcaccagttgttgtaaatgcttcaacactaatagaatcttgaatttcaatgatgttaccttcatcttgtaaacctttagattcatcagtagttaatgcaaaataaatatctccagcttttacatcttctttagttccttgaacaacttttaatgacctaccagtcatttctttataatcatcagctaaagcttgggcagttttctttaaactactatctttataaacaactttacttgatgattggatagtatacttaccagtaaatcctttccattctctaagttcaggtaatactactggtgaagcattatctccttcttctttagaatattttccaggaattgtttttctgatttctttaaaagtatagtcttttgttttcttatcaaccaatttaaatgaaacagatacttctgtatcaacgattggttgataaattctataatctgtatctacaacttgttcataatcagttccattataagtaatatcataatcttcactacttggaatattcacttttaaatgagtatctccaggtttaacatcatcaatagtgattttatcaccaatttcagaactatcttcttttaattcaccaccataaacctccatttcataaatagaaattgtattccatgtaactccaccatcaggatcatctgctgtgaatgaattaatttttaaacgtacatatcttgcctcaacagcttcatctaatacaatacgttcatttttatttttaggtcttgaagtcgatgattttactgtagtccagtcagaatcactcataggtgatgataattcatcagcaacttgaagttcataacttgttgcctttctattttcccagaaaacttttatagttttcacagtatatttttcacctaaatctgtataaatccaatgaggaccatttccaatatcacttccccaacgagaatctctagctgatgcatttccatcgaaagcattagatgcctctacactaggatcttcttctgaacttgcatatccaggtttttttaatgcaacgtttgcagtaggatcttgaactttatgctctgttaaagatacttcaaattcacgtgcagatactgaaggatatccaaattgtttagtaacttcaatttttacataacgacctgatacaggttcagaaatcatttctgtaacatctttttttgtattgtctgttcttgttacaacagcattaccaaagttatctttatcatcagatacataaattttatatgcgcttgcataaactgtatcgctttcccaaataacacggaatgtattcattgattcagtttttcctaaatctacataagcccattgaactggtcccatttcagtagaccaacgtgtactttctttaccatctgttaagttagctttatctaaattagctccatggtttgctgaagcagtaactggtttatttaaagctaagtttacatttttttctgtttcattgacgttatagatttggaattctctaattgttacattttgataagcaccaataacttctttaactgttaatttaacatatctataagatactttttcacctaaaacaacactgtgatcacttgtaaaaccatctgcttttgcatcttcatgtaataatgtgaagttttgattatcattagatccttcaatcttaaatgatttcattttttgtccaacttcataataaatcataaacttattaaattctgttttgtcttttaaatcaactgtaattgattgagctggtttataaccatctgttgaccaccatgtttctaaatttccatcaattgccattgctgcagaacgagttgtatcgttgtattgtgcagtcgctgttgctgtttttcctaagcataagtttgtaggttctaatgcgttaactgcttgaggcatcattaataacgaaataagcattattgctgttaaagccccacataaagttttattaactgtctttcctttcatagtttcccttcctttatttgtttttcaatacatgattacacctgattacgtatttttccatttcacctcaactttccaacaaaaaagaccgaatgtaatatagacacacttaaaaaatgtatctatattacatttggtcttgcctgcttaaagtcacaatccaaattgatataaattatattatactcttttttctatacatatcaatatattttatgcattttttaaatatgtatacataaatacatgaattaattggttttagaactgattatgagataatgaccaagaaaaagataaacttcttaaaacatcaagtaatagatataaaaattggacaaaagtcatgtattgcatcaattatgaaaaatccataaagatatgggcaaatattttaatatataaaaacacaatgattataatggtagaagaccacatataagaggcagtgaataactacatattcatatacttgaagatatatacaaagcactcatagatatgaatatcagcattaacgaattatatagacagatttcaaatatagagaataaaaaaactcataatgaggatttggctttccattatttacactctcaagaaaaaccgccgctatggttttacccatacacggcggattacatagttttatgacagcatttactgcttctttataaaaaacctctttaattttcgctatctacaaattcaaacaattcttcgacagccacattgaatattttcgctatatccatagctaactttaaggaaggattatatctgccattttcaaggtgaacaatggtttctctccttgcaccaaccatctcagcgagttcactttgtttatatcctgccttttctcggtattctttgatttttgtaatgagagccatattacacccccttgctatccataaccacaaacatcactgttctaataatagataaaaccaaaattgacaaaacaattgtccacccaataaatcctgtattgacggcatttgcatgaccgagaatggcagcaccaaaagcaactacaaccattacaccaacaaaaatttttaaacaaattgagtcacatcgtttcaagttttgttctgccatttcatcaacgccttctttcttgtaattcttaattctcacatactgaaacaagaaaaaagcaatgagaacacagccaagtacatactgtgctgttaaataccagtcttcccaatcggttcttgcccacatccaatagtaggatgtaagaatgatggcataaacaattttagttccgacaatttcttttaaagatacttttttattcatattaggctcctctcatgttatatatttcgcacttgagatgttataaatatatcgccttaacttatgaatgtcaataaggtaagtgaaatatttctaactttcacgttttcctaaagacaaagcggcagtgatttctccctgtcgctttgccttatgcgtaaatgatttccgtgttcacaatctccacagcacaagctcgaatgttattcattcttccaatccattcaaaagcattttcagcttttaactgctctgttacaccttgcgcctgtttcatttgttcgataaatgtttataaacgttccagtgcctgtttgttgatgtcagcaaaatagctgttcaatttgccacttatcaagagcgttgtgtaagttacatttttatattctttcagatagcgtttgtgttgctgtccccataattcttgattataagtccctacctcacacacaatcctttgtttttttgtatttgatttacttttcttagcaagtattcatgatcagaaatcactaatagaattatatccgtattttctaaatacgaatgtgactcaatataattttttatttgaatagccgcactctctccagttatacgcaaactaatgattgcttaagaattctcttgtttttgatactattgctgaatttccgaatatatttgttgataagaatcaatctcttcaaagaatcgtgacagcccacttttcgagaacagtctaatgcgataagggtagctgggatacaaacatatttaatgtttattccagtttcaagacttatcatctctgccatatgctttaatgaccccatatcatacacccccactaggtaagtttattaaatatacttaattctgtaacacccataccagtgttaagcatatttccagagccaaacataccaatcgttgaagcaaggaaaaaacatacttagtccacctccaaaagccattgccccttgatctacctggtctgcaattaaagaatttgataaaataataatcagaataaatattggaagtaacctcattgcactataatacatctggttcatcatagaggctggatccatttcactcattttttctaccatatctgatgaaaccccatcatatctaacgtaatagtcagcattcgtgaaggagttaattcttctttatcaaacacaccctcggactgcttcaagcatacgcatattcaaattgttttacatatttgtcaatactgaattaattctacctcaattcaatagttttaactaaaattaataatagcatctcttgattctaccagtaaaataaaactattctcagatataatattaaatctaagaatagtttaacatctaaattttactatgtcctaaaacagggtaactgagattaaatcatagctataatgattataattaagcaaatccgtgataaacaattcgtcacggattcaggtttaattaattttcttttttcttctttttaagtaaagcaatcccagtagctgctactagtaaagttccaatagccataaagtttgtattgtccccagttgcaacacctggcttagtaggttttactggatccattggtttttctggctttgccggtttatcaggatcgacaggtttaacttctaatttatcaattgcattattgattgcatcaactgctgcattgatttcttcttgagtagcatctttgttttctagaactttattaccagcatcaattgcattttgcaatgcgttccatgatttttcagtatacttgcttgcatccagcttatttgctttatcaataacagtctctaattcacttgtatcactaggagctttaagacctttgatagcatcatcaagtgttttaagtgctttatcaacttgttcttgagtagcattactatcttcattaacaatgattgcttctaataaagctttttcaaatcttgaccatgattcaatagaatagttattattttctatttcttttgcatcattaatcttatttgttagtttttctttgtttgaggtaactgtatctcttaatgcattgattgcattacgtaaattattagtttcttcagttacatcaacttttccttcaacataagatttttgagcaacaattaatgcatcaatcatttcatttactgagccactagatttaccagtaatatttaatgtttcagcttctaaaatcatatcttttaaagttgaatcttcaggtatttcttctaattcaaacttaacttctgcaatttgataccagttccccttaccttcggtaagaacaattctaacatatttagtcaatgtcttatcaaaagtaatagttttttcaaatgctgaattatctaacgttcctactgttgtccaattttttccatcagtggagatttgcacatcagcaccatcaattatatcttcaccagcattgcttggttgaatgatttggatagaactaatatttattggacgagtaaatgtgaatttaacttctttaccaatttcttggttgctattaaaccaacatttagtattaatattaccatcaatcatattattgtagttattagattgataataagtatcagttgctgaaatagttggaactttagcattaggtttaactaatgattgcttagctgtttgaattgcattataagcttctttagctttttcaacagttaatccttcactattaagtaatgtttttcctgtagttacagcatttttataagcttgatatccacttgaatagtcactttcatttaatggatatgtaacttcaacatataatgaataatattccaattttacagctttatttttagcatcttgtaatgctcttaatgcgttattaacagctaattgtccacttgtttcgtcaaaatatatttcttttgccattgttaatgctttattataatcagctacagtttcattaatatattcacttactgctaatggttcaaatatttctttttttaaatcagttttatcacaatgtaattgatattttaaagtaattgtcatattaccgttatatttaccatctaatggtaaatctgattcaataaaactatatccaaataattcttttgcttcaaaatgatactcactatcatttagaccatagaatacatcatctgcagcaatagtcttaccaaaattatcaatatatttgatagtaactgttgctgtatcttcaccctggaacacttcacccggagcaggtaaagcctcattgaagcctggagttcttcccaatttatcaacagcagctttaaaaacatcatagtctggttgattatcgttcgcgttccacatcttataagctgttgcacgtgtgcgatgatagattttatcttctacgctttgttcgctttcataatttggatcatcacaccaaactgcgtaagaaccacccattacatattctggataaggttcttcaaaagtttgtgctgttccggataagttagagaatttaccaggatgccattcattataaatacgatcaccttctggtactgcattagtttgccaccaccaagaaagtacatagtacatataaacatcagaatagttgattactttgttaccattagcaacaaaatccgctaccgatgcacagttttcaggagctgcccagtaacaaacttcaatgtcactatccaatgtataaccctcataatcaccaaataataaaccatcattccatgctcttggagtcattccgttatctttaactatcttagaaatatcattaaaatatgtcataatttgtccgtattgttcattactaaaactagagaatttagctaagaactcatcaccgccaatattaaaatgtttacatcccgcatcaccaaagaattcaataaattcagtcattaaatttactaagaattctctagcttcaggatttgtaaagatattaaagcattgatttcgtcgatcatcggttgggaatagttctctacaactgtaatcagttggcagatattgtaaaactgctcccaggtgacctggagaatctaaagaaggcacgatttcaatatgataatcattagcaacttgaataatatctaaaatatcttgtttacttaatacatcatcatatttatatttaaatccttcgattgcatccagagtatcactttgaattctaaatccttcattttcagaaaaatgaagttgaaccgcattatatttttgccaagataaatctttgatttgacgaattatccattctttagagaatggtttacgagcaatgtctaaatgcattgaacgtaattcaacatctggataatcaataacagttcctttctctaatattttatcattaatctttaacatttgaattactgacattaaaccataataaataccaatttcatctttagcggttactgtgattttatcagtaatatctaatttgtagctttcagcttttccttctaattcagccacatcctccattctaacaacaatatcattaactactgcattttcttctttaccgaatactattattggggctttggataaaactccagcggcttcaaaatttgaactagttaattttaaatcttttaataaaatagtattatttaatgttttttcatttgctactacaaaaattcgactattttcagcaagagtaaaatcttgccccgcttctttagtatattgttgaacatttggataagtcattaatgatgttgatgcattagcaactttagcagttgctaaaaatccagacatcacaatggctatagaaagtccaattttaaatagctttttaatttttttcatatcattccacctcatcaaagcgcttacataaataaatatatagaaggaccgcactttttatgataatttacggtccattatcattaattaatttagttttctttttttaacaaagcgataacagcagttgctgcgataagagttccaatagccataaagtttgcattatcaccagttgctacacctggtttagcaggttggtttggtttagcaggttggtttggtttagcaggttttactggatccattggcttttcaggttcaattggcttttctggttcaacaggtttagcttctaatttatcaattgcatcattgattgcatcaactgcagcatcaatttcttcttgagtagcatctttattagccactactttatttgctgcatccaatgcatcttgtaatgtcttccatgattctgaagtataatctttttcaactaagtctttagctgcttcaatagcttttaataattcagttttatctgctactataggagctttaactaatgcattaatagccctatctaaatcatcgcaggccttatcaacctgttcttgagttgcggttgtattttccaaaacttctaatgctttgttataagcagcttctaaattattccatgaatctactgtataatcagctttatttaatttttgtactttttctatcagtcctgataaattagtaatatcagctgcatcttttaatgcatcgatagcatttcttaaagtcgtttctacagttgtagtatcagtagtacctttaacatattctttttgaccagcaattagagcatcaaccatattagatactaagataggggctttaccatttatatctaatgcttctgcttcattaatcatatctcttaaagtgttatcttcttgtggttgttcataagcaaatttcacttcagaaacttgataccagtagcctggtttagcctcagttaagcggactcttacatatttaactgcaattttttcaaatgttgctgtgtaatctaaatcattttcagtaattgatccaactttagtccatgtttcaccatctaatgaaacttcgatatcagcagctttcaatgcatcatcacctacattagaaggctgaataacctgaacacttgtcatgttgacagctgtaggaaaagtaaatttaaattctttatccgctgcttgttcttgtccaaaccagcacttagtattcaaatcgttatctaacattttttcataactatattctttagttggataccattgattcttttcgtaatagttatctgtagcggtaattgttggaatgtttccatcaggttttactaagtttgatttagcagttttaattgcttcataagctcctttagcagtctcagcatttaaagtatcgctagataataatgctttaccagcatctacagcttgtttatatgcttcatatccaccaacataatcatcttgttttagtggatatgtactttgtacatataatgaataatattctattttaactgcttttgctttagcttcgataagttcatcatatacttcatctacttctgcctgtgttgcatcagttttatcattaatagctttagcagctattaatgctgttttatattcactaaatgtttcattgatataatctttttcttttaatacatttgttacttcgttatttaaagccgccttatctgtatataattcataagtgaatatataaacagcaccttctttagtgtaagtaccagtaattggtgtattatcaattacacggtatccataaataggatcagcactaaattcaaatttttcaccaactgttccgtatttaattacttcatgttttaattcttgattattttcatctacgaaacgaatagtaatttttcctaaatcaccagctgttaagaattctccagcatctggtaatgtagatcctttttcaaatccagcaacattacctaatttagcataattttcttggaaaccatcaaaattgataattgcgttactgcttgtattccatgatttagaagctaatgcacgtaattcatcagcaatatcttcagtaattacatcttcgctacataaatttggattgtcacaccaaattcccattgaagcacctttaataaaatcagaattatcatctacagctgggttaccttggaattttccaggtgtccattcattatagattttacgatctgcattcaaattatcaaatgagtgttgttctctaccatcagtaggtttatcattacgtaatacataatagaagaaacttgcattgatgttataaattgtatcatgacctttattaatgaatgtttgtaaatttgcaatacttgaattccatgacatttgtgaccagaaatcaattccaatatagtcatgcatttttattttttgtgcaccttcataagagctttcaccgtaataaacaccatcattccaaattcttggtgtaaatccacgatcatgtacatattcagctaaatcattaatatatccggcaattacgtctttccaaatatatccttgaccatatttttcaactgcataagagtttaatacactcttatattctgtagtgaatggcggacggtcaaactccatatactcatcgccaccaatatggaaatcagtacatccttcaaataaatccatatattcatcatataaactacggatatatgcaatggcttcaggattagtaacatctaaaccagatctataatgatttccgctattattaacttgcccgtattcaggatgagcttttaaaatttggtcaacatgacctggactatcaaatgatggaataactttgataccgtattttttagcctctgctaaaatttctctaacttctacttttgttaaatattgatcagaaacgatagctggatcagtttcacattcaattctaaatcccatattttcagaaaaatgaatttgaagagcattcattttcatataagacatttctctaatttggcgaataaaccaatctttagaaatgtattttctagcgcagtcaacatgtactctacgttctgcaacattcggataatccatgatttcaccgtaaactaaaccatcattagtaatagctaaattttggattgttcttaatccatgcataacagcattttcactggcaccagttaaacgaactccatcttctccaattgtgattttatatgcttcttcgctattagagttatttgtaattggatttgttttatcaatattgattaaaatatctccataactaacatctttttcttgagcaaaaaccattgctaatggagatgaaataattcctttttcaacaaattctgaatttactaatttcaccacttcttgcaatcttacattttcgatattagtttgatttgctagaacagctaatcgactatcagcagtcattttccaaactttatggctgttatctgctttataagattgaagaacgggatttgttaatgcctgtaattgttgatcagtaaggtttgaaacatgatcgctagatgctgttgtaacattatctttagctaaaacgccttgaaaacctactgattgacaaataatagcagctaccaaaagtgccggtgcagctactttaagtagcctattcattgatactttccctttcattttctactcactttaaattaataagttaatacatatactagtttttattaatgttgcagattaggtaaatcagatcctccatataaacaaaaaacagtatgactaaaataccttatctaaaggtttaatttatgataattattatcagttgttttatcaataatacgatattagtaaatcattataatttagtagaatagtaactctactgtgtttgtgaatgtctattagagcgagtcccaaaactataagtaatacccattaacatttcaacattaatcattcactagtgttttatgcgttatttaaatactaatttaactcctttcttgatttttgttttcccttttaaaatacaaatatttaaagttagcgcttacatccctccttacataatgtatttggtttaaataaaattatcatattcttttataaaaacctaacactgcattcacttctacaacaattatatcattataaaaatgtatgttcaatagccttttatgcatgttttatcacttttagcaaaatatttaataatacctgtatacgtgatgaaaaatacaaatatttggattatatgagaaataatctaaacatttttctattatacaatgcactcatctggtgaatacgataaaatattttcatcatttattttagagaagcattttattaagaatataaaagttgaaaatattacatataaaagcggaaaattcgcaacaaacattttatacttcatttaactatgagagcatataatactttacgaatattggacaattcagcctataatgatacataaaaaagaaataagagtcatacggtggcaagaaagcgactatcaacagacattaaaacaatgataataacagcagcaaaatatgtaaaacatgcaagattacaatttggcaatagatacacaaacataatatataaaataggaatgtgtataagagaagtaagtaactttgcctatatcttttgaattttatgtaattgttttgaactacacacttaaacattaattatttacttttaactgacaaattaaggttttatatttaactaatataattggcgtgtggagtatatcctgtatcaacctacatattttcactattaaaatatacacatagggggaaaaccacagtcatcatttataggatatacgtctagcccatttcacatattatataatatcaccaatctttaagacatttttatggcctgccatgtacttctctatttatcaatattaataaaccgctctacatttccctcaaactacactttttattcttgcatcaatatgattataagctattctcacaaggtaacaccttaggataatgcttctaccaaatccttccgttcattacgttcattaattaaaaggaaatgtttaaatgggcaaaagatatgtgactataatcatgtatctagattagtatttgaatatattaatagtttttataacactctaagaattcatgaacattgtgattaccaatcaccattaaattatgaaaaagaattcaacgaaatattaaaaaattaggatatctttgtccgaaattttgacagagtataatctccttgccctttctctcattaacaaaacaacagtatacttctattaaaccggatcgttttcaagtagaatattttcaatttattcagaaattcccaaatatcttcaaaactatttaacatcttattctttagctctatatatgcttttttcatatcattcctacccattttcattagtaccttgagatctttttttaccaccgatgtattcttgattactgctatacaaccattttccttaatactaccacttattacttttcctctaaaaaatgaatactctccataaaatttaaaaatcagctctatgtcataccaataactttccatctcaataataccatctatcataaatgtcatctcatcgctgtaaacgatatagtcatatacgttctttctatcaatttttgataaaatattactgagagacatatctatcatgaacaccgctcctatgctactcctgtatgtttcttcaagtttatattcaaatttcaccgctctcaccgctatcctttcttctttgacacatactctatctccagatgattaatatacttttaactctacctccagtttctttcactcttggcgttttatttgtcataacttatacactcgatctatatttttacttatagattttatcaaattagactatcatataagttgtctcaatcttctcataatctttacttttccgctgatactgtcctatctgatactgtcctatagagtatatttcttattaaatatactctatctaaattatttttatcgtcattatttttctccacaatacatatagtaacaaaatatacccctaagatatagaatgttgaattgtggtaaataaatccactgataaaaaataatatacctgccactagatacaaatagtcacatatttttttcttaatcacttttttctcctaattcataaatattttttgtactaaaaaacattgactaatagttattagcaaatagttatcattaaattaatcaaacgaactacatttgatctattaataattatctaatgctttaattagaaaaaggaatatagctctagacagttaatacgtaatcagtcctacactatattccttttaaaaattcatacaggttgtatacatccatctaatttttttatacactaaaattcgtctatctttcgcatagttgcacatattattgttaaaggttatcgtatttttttcactgcacgtccgctagaagaaacagcgatatggaataccgtctgttctcatagtggaacttcctgtattacttttgatattccgatgagaaagcagtatgttgtttttagaaataataagactgtataggcctacaccttttgtataatggtttctacttttgccatatagaaacgtttcacaccaccaataatatattttataatatcctttttacctataacaaacaccccttctttggtagatgacaccactctaccgatgaaggggtgttttacacaaattattttacaatctcgattaaaaagtacaatatatctgtttaaatcagtaacatatggattgacttcacaatttttattaagatatttttattttaaacacaaaaaaatctttattttgtagagctttatattttatattataattattcaaaagattgcttacaatatataatcctaaaccattactactttccttattcaaatcaaatttgacttcaaataatttagttatatcagaaactttattatctctatatgaattttcaatatacaaccagcctttatctaatccaatattaataattccatttacgtcagtatattttattgcattgctaatcaaattagatagaataatttttaaagctgtttttcctatatagacattctcgtctaatatataattattaacagttattttcttttgatttgctaatatttcatacttttttaatacatcttctaatgtatcatttattttcaagtattcttcatcattattcaaattttctatagaatgaactgataatatttgagaaatattttttgttaaactatcaacgatttcaatgcattcgttaatataaatatctctttctttatattttccaatattatatttcatgttttccagtattattttaagactagcaagaggagttttaagttcatgggatgcacctttaaaaaagtcatattttaacttttctaattttaaaatttctttatttttaaattccaaatcgtcaattgttcttaataaagtagaatacaaatcattaatttgttgttttaattctccaacttcatcattagagctaacttttaaacgcatttttttatcaagtttcatcattttatcagtaacaatttttatttcttgtatattattttttattaattttgcataaattaaagaaataatagcagaaaataaaattgatattaataaagaatatggtaaaaatttaaggcttaaatctttcgcatctttttgcatatcagctgtagaaacaaattgtagatgtgtttttttaccatcattaagctttatttctctttcttcaattatcaaagaattactattgctttctaaattaaaatttatattatctttgatttgtaattcattattattatttttttcttttataaatgcctttatttcactactcttagaataaagatccagcgtttgttctatatattttatttcttttccattcatattactggaaatttcatttgccttattatgaatctcttcttttctggtttccaaatatgttttaggaaaaataaaaaaaactaatgaatgaactaatataattattattccaagaacagaaaatatttgtatgaacattttgggaaatatctttaattttttcattttctctccaatttatatcctacatttcttatagtagttatacagtctaattgtaatttttttctaagttcttttatatatacatctattactcgatcataaggaatttcttcgctatctttccatacataatcaataatttgcattcttgttaacacttgtccattattatccaataaacattttaatacttctagttcttttgcatttacatctatttcttcaccatttattttagctgtatagctattaaaattaactgatagctccttatattcaaacttctctaaatgtccataattcttcttaattaaagagtctattctagcctttaatactggcaatgaaaatggcttttctacatacccgtctactaaattagtaaatgcgtcaattttatattcttcatcactaaatgcagtcaagattagaattggtaaattgcttttctttctaatttctttcaacacttctaaaccatttataaaaggtatctgaatgtctaagataaccaaatttatattgctattaaattttgacaaggcttctcttccatctttagcttgaataacagtatatccaaattctgaaagatattcacttattccctctcttatcatattatcatcttcaacagttaatattttcatatatacctccacttaagcctatacacttatattatacagcatattatttgatatttaaaagtcaaaaaactttcggtgctagaaagcaccgaaaattttaattattgtcaattaataattcttttggatcccttcttaatatattgaatgaagaaataatcaatgatacaagaagcactaaactcataaatataactacataaattatgaatttaggtaatacatttatatctaaacttgataatgtcttgttaaatccttcagcttctgccccaccacctaattggctagatgcagattgtctagctatttgtttagctatatcaccagtaaccttattcaatatattattcccaagcttatcagctgtatattgagctaaaaaataagaaccaacgaatgcggggattgatataaataccatctcaattaggaattgaccaaaaatttctaattttgatatacctaatgatagtaatactgctatttctttctttctagcattcatccataagaataataataatgaaactacaactcctgcaaatattaatgagccaacaaataatttatttgaaattgagtagatacctgatatagattgttgtaatgcagggtaatttgatgaacttttaatcaaattatattctctccaatttatatctaatttcccaagatcttttattacactatcaagattcttatcaccttttacaaagaatgttgcatcttggtatacagctgtatcttctgtattaccataaactttagcagctgtatgaacatcagtgattaatgtattttcgtatagttcttgtgctgcacttactccaccgctattatgcccatcgaatagacctttaatttctacttctactgtttcatctgcacctttctcattatcagcatcaaacaaattagattttatttttatcttatctccaactttaagattatttttttcagctaaatctttatgcattaagattttatttttatcttcattttctaaatgctttccttctactaatttatatgcttctgatacaaattttgtttcttttgatgaatcgttaaccccagttatcataactgttcttttaaaattcttcgctctttcaggtgattgattcgcaagagtctcttgagtttcaataatatcataatcaactaaatctgcaacactgtttattctttttacataggagtctatactatctgtttgagatatctttttaatatcttcaccttttacatttcccccacctctaggtgttcctggatttacttgtctatttatctccatagaaaaactatttgttatattagcaaatgtttcttttgaagctctgtccgtagcatctttaatagataaactaatgagacttaaagttgacatagataaaataactaatataataattaatgattttaagctttttctagttacataagcaaatgcattttttatcattattcaacctccaaattcattttatttacttttttcaactttttaccacttagttctaaaatgatatccgcagaatctgctacttccttactatgtgttacaactattacacatttatttctatctttagctaatgtctttaatatattaattatttctccagcagtaacactgtctagattaccagtaggctcatcagctagtattattggagcatctgataccaatgctctagcaatagctactctttgttgctgtccaccagataatttcataacatttctttttatttgttttttatctaaacctagttcaaacaagatactttcatctgctgatttatttactaatctaatattttcaattggtgataaataatctattaaattatagttttgaaatactaaagatatattattttttctatgattaccatatcctttcttttgtatatcttcattcttaaacaatatttttcctgtttgaggtttatcaagtccagcaagtaaggagagaagtgtagattttcctgttcctgactttcctactatcgcataaaacttcccaagttcaaatttttgatttactcctgacaaaactttttctttagaatttgcataactatatgctacattctttatttctaatatatccattattttctcctaacttatttttgataatatttctttaggcttcttgattaatattaatgaagaagcaaatacaactgataaaacaataatacttattaatattaaataactttgtccaagtgttgttatatttaacataaaactactattatttattaaacttccaccggaaattattgagtcctctgagttaatgaatccatctacaattacttttagtaatacatttcctaaaaataaggaagatattatacttggtatcgatatgaatattaactcgaatataaattgcattataatttgtatcttagatgttccaatagataaaaatatacctatttcataaattctttctcttaaccatagaatcaagattaatgaaagaacaaccatcccacctaacataatagaataagtcattatttttattatatgttttattccactcactgactctaaagactcttcaaacgcattagaatctttttcaacaaaatactttgactcatcaattttaagctctttcaatttgtttaaggctaagtctgtagattctgcactaccagaatacattaaaattttatttgcgattttattattttctgatttatttaatatctcttggcttgttgaataatctacaaacaccatattttcactaaaatcagaagataatcctgtatatgtttcctgttttttaccagaaaagatccctataattttaaatttatgactttttatttttccacttttttcaatatctagtaattcaagatcaacttcatcacctaattttagattgttttgtttagcaaattcttcatgaacaataattgaattcttatcattttcttctatatttttaccttctttaattgtaaatactccactactaaataaaatatttcttttagtattatttgtagcttcgagtgaaacaacattcttaaactcgtcagataaatcttctctatttattctttgttctccgctaactactttagcatcttttagttttgctaatccatcatattgaattattttttcttcaatttcttttaatttttcaatatctttaaattgattaacattaaaatatttaccatctttttttgttattgatattgaagaattagaactttcatataaagccttttctatttcattgcttgatttcattattgttaaacaagaatacaagcaagaaagaactatagttaatatgataaaaattattaaagttctatttctctttcttgtaatatatgctatagcattttttttcatctttttacgccccctctatttttcactccacaaaataagtattcccacattagcgcaattaacatacttcctttataatactataaaatgaataaagatcctctcagaagaaaatcacacttaaaaaattctgtatattcctatcgaaagcaataaataacggaaatatcaaaatcattacctttcaatggtgcaaaatacctacatctctctcatacttctattttagtgacataagaggtatttctttccctaaaatctcaactagataaataagttcgcaggagcacgaacccctctattctaacatgttaacaaggaataaaaatagtaatattacacatcttaacctcttcaaatacttttttctttgaaaacggaatctcgcgtagtaaatcttaaactaacttctattgaacaaaattcttttacgcctgagtacaaacaacaatccatattcagaacacaagtttttttcaaattcccatcataatttttcctcctttatttattacacaacagttatccataaccgcttcataaaatatattacacactttttatgaatcactgatgaaatatccatttttaattttatattttcttcagctatcataatcattcctttgtagcaaccgcagctaattactaaaaagcggtgcacggcgtgattgaagcgaactctaattgttggacactaacttaacttgtttttagatagttaataaggattgattcctgtattgtacaggaatcaatccttttaattttgttgtgattctctttgtattataatattcgacatattcttccatcgcgatctttaaatcacctaatgtttcaaaaatatgttattggcgagctatctaaacagttgccttttcttgacgtcgactgctttattcttttatcatttaacttctttttgtagttctacatctgatactgccatctttgatttgaatgtataatcatcacttcaagattaccatactttgaaaatgcctcatccagcatatttgtaatttggacaaagcttggcgaagctgagatatcagacaatatctttctattatgcagatctaaaatagatgatagatatagtttacctgctgctatataaaattctgatatatcagttggcaatttttgattacattctgatgttatgaaatttcgtttttgacacgtttatgatttatacttgattttatcgtaataccctatcttctttatttgctgcttttcttgtgtagtaacaggaagatttttctttgcctacttttgcccttgtctagcgcttctaattatttatcacttgtagactgctcttagatctttacaaaattcttttctatttttataactcaataatttacatgcaatccgaattagatgaattctaacttatattatttaattatttaatatctccggtatttaaataatatacattgataaataaaagaaaaagttcaaaaccggttattttaagccttctcaaattattaaatctgcaggtataaccctatatcactatgaatcgagtcagtttaatgcacagtacacagccataaccaagaagggttttaaatatcttagaaaaacgttgtatcaaatcatactgcctgtcatcaataataatccctgtattcactcaatactaccaattaaagattttccgaagaaaaggacaccgcagtactcaaggttactgcataagaaagctacttagcatcatttatcatctgctagaaacaggtcaatcatttgaccctgccttattgagatagggcaactttttaaaaattcaattttaaaagttcttttcagcatgcctgtatttaatccaatattcacattttcaaaaatctagtttcaactaactataaaatctaattgttttacattttcaaactttttcataaaaactacttgaattttatatagttaactcctcttttatgcagcagacaattcaaaaacaattattatactttcacaattaagggaatatcactttttcctctagcagacgtgcagtggaaaaagacaataacctttaacaacaatatgtgcaactacacgagggcagaacggaaaagagggatgaacaaaatactttttagttgcatttcttaagggcttatttgttgatctgctttgcagaaaacaaataaaagccaacaatctataagttacaatagcctacaaattatcggctctgcgtcttagcaattagcgctttgataataattacttttccctgctttatattgattaaagtttccttttttcacttcggacagaacaaggggaaatttaccagttcctatcttctcgtattcttgtccgtatcttattactacaaaatggacataatacccatgactgcttatccatagaaccacctcttattcttttaagaaatttaatttctgctttaacaacaatcaaaaatatagtttacttattatgaacgagtttctgtaataccgttttctcctcattgttaatttccaaacattgatataataaatctagcgatgcttcatcagatatacttttctctaactcccattttgaaatagtctgtctggtaacatacacagagtctgctaattgttgttgagtcattccttttttattcttgcctcttttattatttttgaaatttccatgttccgccattatctgtttttagtatctaaaacatttccaatggcgacagctatacacattaacaaaaaactcaaattccattcctgctcaactatcaacagatatatacacatcaaagaaaaggcaacaatagtaatccatgtaaaaacttttggataacgttttgatatttttataattaatattacaacaggaacaagaaacattccagctaagccaaacagagcaaaggaaagcacaaaaaagatatatcccttattttttagtttgatttccatagcaaaacctcctttatttatgctattattttaggaaatttgcttattaaaatcaagcaacgattactagaaatcacgcaacacctaaatcgtcattctatacagagcataacaattacaataatgcaagtgtcatttttaagaaatattgtcaatacacttctttataattttatttttgcctttttagtgatcttgtaaatgtattcttctggcgtagggcgtttgtttccaaaatacttttagaagtttacctgcacagtctttatacatagtactaattttaaaaattttggaatggtgctttcatgctagtgttttcaaacagctatattccacaagacaattgagatagattagcttgttaaaattgcttgccaattcatagtaattacagatatctcttaattctgcattatagatagtcactatttccaaatctgttctgttaagcaattgtgatcggtgtataggctctaatttcccattgtctgatctctgctttataattccatttgttgagaaatttctctatcttatctttgaatgaaatactcaattctaccttgttgttcatagaataggttttgaatttttcttttggtttaatctgctggtcacagcgtactctgacattatatccgagaaaacgagcaaaagtattactatgtgtaatcagagttttttctttactaaattccatctctagtgtgatacttataaattatgtaagttcttgcttaattttctcacaatcctgtcgattaccatttcagattacctcatttcttgtttttttcatataataattttcttaaaaactgtccaatttagtgtattttatccaactctatctctcatatataaagaattgacagaaaatatgataaaaagctattcaaaaaagctacctgcgaaataatgcatgtatagaaacatttcatgcatcaataaaacgtgagtggataaacagatttaaaatccagggttatgaaaactaatatttgaatagttggaaaaatttttaaacacaatgagaatacgttcgcattgtgaatatatgttgccggaccaatttgagaaaaaatataaaatattagattagacttactaaattcttgtatttaaattgtccgaaatcttgacatagtaccagtgcttcatacactgtacaatacctaatcagcgaaaaaatctaattactatttttctctataaagttcatcaattattcatcacttaagtaggtagtaattatctttttatagatgtcaatttgttcaaaataattactaatttccacatattcattgatttggtgaggaactgtagtaacaccaggtccaaaaaccactatatcaaattgtttctgtgactttataaactctgcagcatctgtagtagcagggcctcctaaaactggcaatggtgtatcaaactgtttttgaatagcttgaatcaatgtggagtttttgttggcttcaacgggaattttgttgtaattaatagttaactccaatggaaataaattatcttgatttaattgtgcaactgtttcctttaatagagcaatcactttaccattatcaaattctggtatagtccgtatatttccttgtgcaatagccttatttggaatactatttatttgggttccaccgtgaataattgtgacattatgtattgtttttcccaattcttcattgatataatcgtttgatatcttgtccattttttgattgaataccataatgcaatcatttaaacatctaatagcattatatccctcctgtggcattgaactatgtgcttctttaccattagacactaccgtatagttaatagatcctttatgagcatagcctaaaacatatccagtaggttccccaataataagtgcatccaaatcatctgtataaccttcttttgtcaattgttcagctcctagttctccaacctcttccccaacagtcgccaacaatttgattgtcccattaaatggacatccttcttcttttaattcaatcatagcaatgaccatcgccattaatccggccttcatatctgtcgatccgcgtccatagagacgattaccttcaatatgcgcctcaaaaggtggataattccacatgctttcatttccagcagacacaacatccatatgcccagaaagccctaagactttgccgtgccctgtagaaatagttacaaccaagttatctcgtcctggacaataaggcactctttcactttcaatactgtaatctataaatagtttagaaagataggatgctacttctgcttctttcccgtttactgatggaattcgaataacatcttgtaatacttgaatttttttttgatcattcatatcttatacctccaatatcattataatctgctactattagtttagctcagaatttagaataataaactagtataaatgaaaaacgattaaaaagatgcataagccaacatcattattcaaatcttttatttcatttttataattaaagagttcttttagccaattactgtaacttcatacactaattttaataaaaaagtaatgatttaacattttttaatttggattatattagctaactcgtcatcatcaaattttatacaaaattctttttcaaacagttgtaaattttctttgaaatcattatataaaggcttgtttcatttcttattgatttattctcttttctttggcaaaattttctttaataactgaaggtcaaaaccttccaactgttcttccaagtaagcatatatcgcatcataatttactgacatgacagattctacagtttctaaagataacaaaatatctagtttatctgatgaaatatcaaatagttttgaaattggaatgtatggtataccatataattcttgattataaatccctacctcacacacaatcctttgtttttttgtatttgatttacttttcttagcaagtattcatgatcagaaatcactaatagaattatatccgtattttctaaatacgaatgtgactcaatataattttttatttgaatagccgcactctctccagttatacgcaaactaatgattgcttaagaattctcttgtttttgatactattgctgaatttccgaatatatttgttgataagaatcaatctcttcaaagaatcgtgacagcccacttttcgagaacagtctaatgcgataagggtagctgggatacaaacatatttaatgtttattccagtttcaataaccattaaaagtaaagtctaaaaatgctaattattgaatgaatcacataattgcatttcagatatatttgaacctttaaaattgtatgacaaatagagcatctatacatgtgctcaaaaagaagatatttatagaaaagaacctaagatgctttgatatgcgagcgaccaaatttttcaagttgataaataactgatgccaagcgcaaaagcaaaataagaaagactaacaatgataaaaaagagacttttcttatttgttcagtattctttgatagagattatactagagtcgctcagcgtaagctcgatatgaaacaagctcgtgaattaactcgtcatcatgcttctgttactgaagatatcaatcaaaagaaaaggtaacttcaaaaatgtattgatatcgttattcctgagtccaatacttggtttagaaccaaatattccaaagcttatacggctgttttaaaagaatttggaagttcttataatttagccggtgccattctcactcatcttctaaagcctaaaagcagtggaaaccatggggatacagacacatcatctcttcgtgccaatgcaaagaaatccattggtgaacaacgaagttataactcttgaaatttgcctgtcttagaatattgattaatttattaaatttaataaaatatacactattacgtctaatggctactgtatatgcaattgctattgctaagtgcgttttccccgtacctggattacctataaaaacaacatttgttgcgttttcataaaaatccgattcaataatcgatcttattttttcttcttttatgcctggctgaaaattaaaatcataatcgtcaacttttcttaagaaagaaaatgctgctacctttacattataaagtctgttattttcctccttggctattacttccttattcaatattttatgcattacctgtagttgttcttcatctatttcattattcattattaatgaatttaaatatgaatatgctgatttcaattttaaataatttaattgttcattacatgagcggaacatcaggtatgcttccttcgcagtttaactatcaaccaaaaagtataactaagagagtgcatcaggctgaaaaacctgtcgagttgctagaggaaataatcggttatatatcgcttccatatgaaattattcttgatcagtttgctggaagcagtaatttagccgtggctgcattgaatatgtctagaaatgcaatcgttattgaaggagttgaaaatatataaaatacctcacaagaaaaaagaaatttagcaaaagaaaattttaatctaatgaaaaaaaatatagaagaacagctgaataaagaagctactataattgatatcaatcgtattacatattctaatgaaagtattgtcggatatgagaaattagaaaatgattatgatttaggattataacaaggagaaaaaatatggaaaataaattaatcaaaactaaaattgaaaatcttatcgaaaaaacaaaacaactaaaaatacacgatgtaatatcatacattaaaattgaatttcctgaaaatgagtttagttgcaaaacattgatgaaagaaacgatttttattatgatcatcgagatattattcatctaacaaatcaaacggaattgattattaattatcctggaggtgacagatttggggatctatatgctgaaccatatactgatataagttttcacagttttaagttaagtggcaataatgacttagacgataacttatacctgtttctaaatgataaatataacgaggggaataaaatactcgactatctgaatgaattttcaagtaatgccaatttttcaatcgaagaaataattatacgtttaaccactatgaatgtaaatattccatatcatattttaggtcagttatcaaatgaagaattacaaaacattaaagtaaaagaagcgatagttaattgtgttgaaaatattgcatttcacaaacattttgatgcatgcgatcaatatcagtatggtcaatacggaggagaagatgtagctgagtggagattatctcaatcacttcaatttaaagaaatctgggaaagcctgccagataaagtgagagaatattgcaatgatgaacttgaaagagcgtggttgcagatacctaatacaaaaaatatactgaatggagaagtagaatttttacaggaaagctaactatatataaatcaagtgatttttgataattagctgaaatattttttagttctttgaaaagtgaattttgtgtacactgaaaactactgctttatgcagaattttaaaaatattaagttaaatatttttaaatcagctgtctttcatcaaatggtatgttttcagacaataatttatagattactcttataagttttcgtactgaatggccctgggcgcatctatgggatttaccttgtgaccgttttagtttataatacttattgaaagtgagattgtatttgcatactgtaagaatgcactgatatagattttttcttaggtagcgcgaaccacgtttagacaatgctgtttgaggagcgctgtattcaccggactgataagtaccggggtctacacctgcaaatcccatgactttgacagcagagctgaagttatggatatcaccaatctcgcttaaaatagacattcccgtataaatcccaatgccgggaatcgaaaagataagagaatctagtttagcatctaattcttctatttttttgtctatagttttaagctgactggttaagagttcaatattttcaataagcatcttaatttcaagagcaataacttcgttattttcgccaatagatttctttgcattatcacgaagagatgatgcatctatctctacatgataccccttgtttttagggtttagaacgtttttgagatgagtaagattagctttggctaaattataagaacttccaaattcttttaaaacagccatataagttttggaatacttggttttaaaccatgaattaaactcgggtataacgatatcgatacacttttgaagacggtttttcttttgattgatatcttcagtaattgaagagtgataacgggttaattctcgaacctgtttcatatcgagtttatgctgagtgactttagtatagtctctgtcaaagagtactgaacagataagaaaagtatcttttttatcattcttagtcttgcggattttagacttgcgcttggcatcagtggttaatggattaattaaagcaacctcataatcttgtttgattagaaagctgataaggttgtcaccgtaatgaccgatggcttctaagcctacaatatgtctaggtgatttaaattttttaacagctttgataaaagaatcaaaaccatcagaattattaggaaagaagaaaggttcatgacagttaaataagtcaattacaataggtttttaaagtttccaattttctgggttcacttcaatagcacgtggtttttgtttcacaataaaaactgtgaagtcaatccgtacgctactgacttacacagtttatattacactctctatttctatgtaatttaattcattatttatgaatattttttagattttttaaatattttttgatcattattataaaagtcattaagcttacaactgctaatgttaaataattactattagcaagatcaccggtaagtggtgcattggcagatgaactagtagtactattatttccatttacactactatcgtttcctggttgaacattgatatcttgatcgtcatcattttcaacaacttctactactctagttacaatagcaacattgttaaagcaatcagttacttgatatgtcaattcgtatctaccagctttatcaacatcgacactacctaatacaacaatctgactagtcaaatcattgccttgactgtcaaaagctttaacatctttcaatggatcaaaatctgttcctacagcaatcttattaaattcatcatcaggtaatactattgttggtttaatattttgtttatcaatattaacataattaacatttgatcttgttaaaccaccattagtatcactaatttcaacataccaaccaaataatccatgaggagcattttctaatgtatagctgatttcttgattacttcttacatcattaactgtaccaaaagtatcatcagtataaatattaacatctaaatttgttgtttcaatttgtttttgaactggtgtaattcctaaatcgctataattaattacaaattcttcttcaccattaatatcagctacatcaccaatattactttcatctttagcattataatcatctaatgaaggtgaatatgttctaataattatttgtccatttgtattatcaaaatgcatcaaacgcatataacccataccaccttgagctaaaccttgataatcaaataacatttgataaacattacgatcattaacaccatcatgattatcatcaaactgcgatactactgtttgagcattatgataatgaccagataaaaccatacaaacattaggattaacagctacgacttcattataaattctttgtggttcttcacctaaaccaccactagctaataggtattcatggaaattcaaaattgcttttctttctggatactgagctaaaacatcattcatccattgaatttcttgattaccaataccccaccccatatataccatgataaagtcaatgccatcaacagtaattaaatcataatgtccacgattgtcttgataactttcaccataccatgggttttgattataacgatcttcaccaaagtatttggagaaagaagtataatcaccacttaaatgaccaacgtcatggttaccagctaaaacaccataaggcatattagcatcatcaagcattttataagcattgtcagcattgatccattcttgcacttgatcttcatcatcaataatatcaccatcatggaataaatactgaatattcatccgttcacgattagctaataaccaattatgaatatctaattgatattgatagtttccatcaacatcttgatctggattgccatcaaagtcttcattataatattgagtatcactttcaacagcaaatgtaaaatcatagttttctcttggtgtatctgctggattagacattgcaccagtaaaatcttctctatattgatcaggggtatatccttcaccattttgaaccataattttgattgtttgatcaagtaagtgatcttttaatattacttcaccggttaatttcatggtttcaccatcaatttccataaccgtatctaatttatcaaaagtattagttgcatagttataagcatacataaaagtcttttgattattagatttacctttccaatcaatcttaacagttgcatcatcacttatatcaccagttactttaacatcaaactgttgataagggaatccatcaccagaatcaccactgaaatcctgagtattattaccggcaatctgactaataccactagatgaagtaatattagcatcacctaatagataacgttcaccacgtttgaaagcaacctgcattaaatcatcagtactatcacttacagtaactttaaatgttggatcaccattaacagttgtcccacttactggtgttatttccccattaattgctgcattttcttctggtgttacaaaatttattaccttactagtaacatttccaatcatatctgaagctgttaatactaattgatgattacctggctccatttctaatgaacggaaatcataaggcaattcaattccttccccatcaagagcagcaattaaagtactcgtatcacaaatagcatcttgggcactaccttcaatagttccattatgataaatttgaccttcaaccatattagtttcaataactggtgcggtattatcactaacaaatgataccgtcttgctaccacttgttacactatgagtaccatcttctaacgcagttgtatcaagatcataacgtaaagcattaaagttttgatcatctaatgtgaaagtagcatataaaatttcaactttgcttgtaccatcacccatactaatttctttttcaggggtaatatcattaacttcaactggactatctggtttccagttatcttcagtatgttcaactgctcctagaccataaacagcactatactgaccagctcttaaagttgtaccatctggtaatgttaatctaatattctttatagtaaagtcatcgttattttcaacattgtgttctaaagcattagctttattaccagcatggaaagcaatagtaattgtttttgaatcactgtcaaaacagctagcattaatatcataagcatatgtccgccagtcactataagtaccttcattgaaaacgccaattacatcatttccaattgcaactgcatttttaaagaaaacatctgtttgagtagtatcaaaaacaattcgtgcgtttccgttaattgatttgactgctttatcagttacatcctgatcatcaattatcaaattattagcggtaccaataatttgttcagtttggttaataatcgcaccttcgctaatattaatttgatcgccagtagaaactggtttttcattattaactgtgctaactggtgttgttatttgttgataaccatcgctaatagcaaaataatatgtatatgatgatttattatataaatctactgctggtaatgtttttgaaaaattatcaccagaattacgtaataaattataaacttcaaaatcttcgctattattatcttttaaatacaagtaaacactcttaattgttgtatcgttagatttagcatcaagcgagaaagttaaatcgttagcttcattaaaagtagctggtgtttgatctttgtattctatcaaagaaacagtttctggtaaaacagcctcatacataggtttttcagttactgttcctggtgttggttcagcgctattatcgattagcgtactagtaaaagttgaaccatcatatctattttgatatacaattgatttatcagctgcagtatcatcaacaccatccatattatataaaacataatctaaaacatctttaatattagaagttatttttaacccacgagccgaaccatttgccattccagcattataaatcgaaattaaatgatcactatctagattagtattaaacttattgttaaaatcactaatttgtaaatcatcattagtaccatttttaatccaaaaaactaatgtatcatgtgatttgataattttatcctcattagtttcataccagataacatcaccatctacaccttgatcaggataattataatacaatttataatcttttaaattaatatccaaatttgaattattataaatttcaatgaattcataaccatcactgccaccgacattagaactatcaggcataatttcactaataaccaagggggcaaccttactttgatcaatcattcctggctgttcgattactacagttttcttaacagaagtcaccttattaaaaccatcagtaatagtaacatcatatgttaaatttgaataagcagctaaatcttgagcaggtacatctacctttaaaatcccatcagtatataataaatcatagctggctactacatttccatcctgatataaatttaacttagcatcaataattgtgtttgtaagattagtattttctacactgacagtgaaattgctatttgcacttacaaaactatctgccccaacttctacttcagggttttctacaatcgctggtgttatatagcgccccgtaattaattgttgactatttaattttcctaatgttacttcattatcataaactggcactccggaatttgaagtgtaattataataaatagcttcatctgtgtcgattttaccattactagaatcactagcagtataattaaccgatgttaattcttgattagtattagtgataattttaaatccacgagtaccactattgctcattccatcactatgaatagttgtaaaattatcaccagcgacaaaattagtaccataattattattaaaatctgcaactgttaagccagtttgttctactgtctcattaacaacccaaactgttaatacttctttagcatctaagacaatatcatcatctaatttccaaactgtttctttattaccattaacataaacaagctggtaattatttacagctacactttggtcactaacattaaaaatctgtaaatattcatacgcatcactaccagaaacattagtactatttggtgataattcactaatcaacaatggtgaagcaaattcaaccgccccttcattaacagtaactgtttgagttgcactagtaatttcattaataccatcattaaaagtagcagtaatatttaaaagatcctcattactaatttcgctagcagggacactataaacataattaccgtcactatcatatgtcatatcatattctttatcatttacctttaaagttgcttttaaaataactcctggtaaattagtcgtagcttttacaaccaaagcttcgccggcattgatttcttgaacagtattaatggtaacaattccatcgcttactgttacaaattgatacttactttctaatttttgttgttcaatcaaactacctggtgtaggatccaagtcataactaaaagtactttcttgaattctaccagaattgtaaataaagttaattcctttttttgtttgtactttaacatcttcatcattataaataactgaacttaaaatttgtttagtattttttactgtaactcgcagttctctttgaccactattagaaaaaccactaacaatattttcagttttaacaatttgtccttcatcagctgacaaattataatattctctaaacaaagctaaatctaaatctttactttcttcattttgaatccaaacaatcaaagcttcattagctggtaaaattgtattagcaggtaaattccactcactaatagtactaccattatcatataatacttgataatcatctaaattaatactttgattactagtattatacaattcaaaatactcaaatgcatctctaccactagttgttgtcatatcactctggtggctatcagcaactatttcactaataataattggtgatgtaacactattttcatttaagatagctgtgtcactattatcattattaactgcttgtaatgaaatagcactattactacctacaacaagagttgtcaccaaggttgccattgtggctttaattactttatttgatttttccttcgtcattttttcgtcctcctagtattacaaaggtaatataacaaaatcatcaacaaagtatgttaatactaagtaattttttccttaattttcttttatataacctttactaaatatttactttgataaaattattttaaaatagcaaattagactttaaaataaaccatgttaacatttaacaaagactaagtccactggatataaggaaattcaattcgtttggaaacctacaaatctgccacttacaaactattatttgacaaaacgtcaaaccagacagatattttatttaattaacataaattttatcctttttaatacagcaaatttacatatttttaagcctgcaacatatttatagccatttttatacaaaatgattactaatttacagaaataattaaaataaataatatgctagaatatctaatgtatttttaatatgaactaaatcaccagtagtttaactaaaaatataaacatacattaagaaaagataaagaggaaagaaaaatgaaaaaaattttaaaaggttcattagttttagctcttacttatcttgtgttccaatgaatacaaataagttagatgcattagcagcttctgatattgaagtaactaattcaaataacattgtaacaattggaaacgagtatattgaaagggaattttcaacagtagataataaattaaaaactactagtattgaaaataaacgtgctaaaacaacgtttgaaccagcgacaggcagcgaagaatttattattaaaacaactaaagagcaaaaagatgctccagttgtaccggcacttaatcgtaatggttggacagcgacagctgatagttttcataacccatcaggaccaagtgatggaccagcacaaaatttattagacggtgatgttaattcaatttggcatactaattatggtgggggaactggtgaccaagaatatcctcataacgttgtaattaatttaaaaggtgaagaaacatttcaagcattttcttatacacctagacaacaaggtgaagagacaaatggaaatattcaaggatatgaattatgggtttataatggacctgttggtgatgatttagcagttgattcatctgaatggaaacaagttgctaaaggaaattttgtttatgaaggagtaaatcctatttatgtaaatttaaaagaagctacaacagcaacacaaattaagtttgttgcgacttcatctaataatggagcaaaatttgcaggtggagcagaatttaattttgagggattatccaagaattaaaaaaggtggaaaacatccacctgatattgaatcgataatttctaaagaaataggaccagttagatccagtcgtattaattctcgcaaaatttaacctaagtcaatagctattttacatatcgattcgattagcataataatttaaaaaatcaacttttccggaagtattgataaatccagaatcatatttaaagcacttttcgaacagaaaaaaattttctttttaatccttatttagattttacaagaaaaagaaaactttcttttaatgaattaattaagttcattatctgtatgaagtcaggtgccattgaagataagctttataagtattttaagaattaatagttataatacttatgaatgtattaccacaaatttagatagagatgaatttccattagaaaaaattaaaaaaatatacaagacgagatagagaattgaaactacctttaaagaattaaaatatgcagttggactcaatgctttagctcaagataaaataaactttcatctgttgggaatactgttcttattttagtaaactttctaaatgcactatttaaactttcaattgcattcgttgtatacatgatttttcttagttctggaacataattaaacatactgcaaacttcattccagttttcttcccatggcttaaatgcatacagatatttatctccccatttacctttacacttatccagtgcttctaatgctttatcacttgtagattctgtatatactgttcttagatctttacagaattcttttctgtctttataactcaagtatttacatgaatttttaattagatgaactatgcatctttgttgtactgtatttgggaatgctgattcaattgcttgtttaatacctgaaagaccatcactgcaaataatcaatatatccttaactcctctattctttaaatcagttagtactgatagccagaatttagctgtttcgttttcgccgatccaaataccaaatatttccttatatccattctcattaactcctaaaacaacatatgcagcttttttggtaaccatattatctgttttaacattaaaatgaacacagtcaataaagactattggatatacagtatctaatggcctgttttgccattgtaaagctttagggataattttatctgttattttacttatcatagctgcactaacttctacaccgtaaatatctttaacagtatcactgatatctcttgtagacataccacgggcatataagttgataattttgttatcaacatcaccttgagatgttttaactgttttttttggaagttccattacgataattagttttatctgttttttgatcatacttgtcatatcccatatgttcatcaaattcagagttcaacatatcttgtaatgtttcacctaataagtcttttaaagcattagttatatcagtaggtgatgtaacaccatactcatcaattatatatttaactatatcttttttactcatgataaaaatcctcctttggtagttaatttcattctaccattggagaatcagtttacacaaaattatttaatagatatcgcctgaactaattccattatccaggcacaaactatttcctcttcattattttcatagcttcacacacgtaatcaataggaggtaaaggagaagaattatataatacaggtttagaatcgctatataaaaaatacaaatattcctttatttttctataggttaaaagattgtattttttagcatattaaaacaagcttttcaatataataaggaaattttatttatatatttcttaacatttcatattcaacaacatagcagcaaagaaaaaattcggtcaacgcaaaaaaattgattaatccaatgttttttatcatataaatcgaaaataataaataagtagaatacaatattagtgagagataatgctataaaaatatctacaaatttaaggatggtgacatatatgaaattgaaaaaattattaattatttctctaagttttattttagcatctacatttttgatcacaccattatcagcttctagtacggtgagcttaggaaaatatgacttcaataatggagagactcctgaaattacaatgactgaaacatattctaaaattattttcacagcatatttcgacgatggtgaagagatatattcgtatgtagataaaaatacaggaaaagctgagtgtatttattggtaaatgcctactattctatgataaaaaaataaacgtactatattaaagcatttacattaacatactcttatttgacacaaagacataactaatacaaaagagtaaaagaactatatatcaataaatttatatggcattatcattcgttatttattaattttacaaatttccaataatatatcataagcctaaaatgaggtattctacatgacttaatatattatataaatagaaagtctttgtattttacctcttttaaactaacataataggtacactacacatatttcgctataaattttactatttcataaaaaaattcataatatatactgattatttctttaataatttttagcttggctttttttaacaattatatcaaaatggcaaatcatcctatgccactcttcaatattgtccagtattacatcatttacatacatgacttattgcatcatataaagcatctatttctttaggagttaaaacaaatattcctttatttttccagaggttaaatgaataataatctacatttgctaaagcacatatcctgctcatatgaaaatattttgattttttcaacagctcccttttggatgactcaaattcactgtcttcaaaagtatatttcctctttttaccgttctcttttataataacttctggatattcaaattcattatcatccataaactcatcaagctgatcctgattactaactcttgttattaatttatcgtttagatcataaatctcaatcattcttttatcccccaaaaaacattttttataacagctgtacggtatttatgatgttggaaaagtatttttacataagatatttccttttaaacactctgaatttttccataaaagaattgaattcatcattagagagctgttcgtctttttcgattttttcaataatcggtctgcactcttccatcattagttttgtatgagcaaccgccttgtcatttcctctactcaattttataagataatcatacagtttgtcatataaatcatcattcataaactgactaaaatactgacagtttttcacgtctataatattaattaagtttcttgctataatttctctgtctctcacaataatcaccgtttaatattatcgcatatattttaataatatcaacagctctttgatcattagctatactgttttttttaattaattatatatttcactcacgctttatgtcccccaatagtattgtttctgtctttgccagttgctccttctactagattcataccttttaatacagcatttttcccatatttctgcttcagtttcaaagttgcctcctgaagtcttttttccttttctaaatctttttcaagcttttcttcttcttctttttttaactgctcgtaatcaataaacagatccatttgctgtattgtcggttttgttttaatactgctttcatcagtaatatgattagcagacaatgcaaaacgtcttattgttaattttttattaacactgctgtgtcataccagtttaaaactttttgtgtaatcagctttgctgatgatgcatatctgcctatattgacagttccatgagcatgttttggaatctttcgtccacatctgtcatcctttatttcgccactatagtcagttttgatgttttctttatcatagccaacacttatagtaatctgatctgttactagattttttgccacaagatcgagacacaacgagtcaatcatttctttaagaattattcttccttcattaaaggtatacggtctgcttaaaacctgtccgcttcccagactgctgctttcaggtttatatgccttgatgtgtttcattgtacaaggttcgtatccccatgcatgatcaatcagcagttcagcattgactccgaacatatcataaagaagatcttcattgtaatatttgtcttcactgcctacagaactacccatagtatacaaccctgcttcattaagcttttttgcatatcctttaccaactctccagaaatctgtaatcggctgatgatgccataagtatttccgatatctcatttcatctaaacaggcaatccgcactccgtcttcatctgctttaacactaaaagacagagtgatactaatgtagcacttaacaatctgaattcattaacaactacagttaccaataagctaaataatggcgattttatccccaaaatcacggctgaagctgaagttggaaaagtatcagaagttcgggtattaggagcaaaagatattcaacacgatgctctagaaaaaatggaagactatgataaggattctgaattgattgttgaaggtagagattatagcacaattaatgacggtcactgcaaccaccaatttaaaaatgagttccttatcaaacaaagcaaaataacaaaagttaattttagagaataacagtctctccccttttgtgctttgcaacatagagaggaaataataaatgttattagattttattaaatcaaactggaaagaaattactacatggttggctttatttggtgttgtggtagaagtttctccgattaaaatttatccacttcgttgggttggaaacagaatgaatgctgacataaaaaaggaactagataatgttaatgaaaatttaaacaaacatataactgattcagaaaagaaagaaatgaaaaacttgaggtttcaagtgttggattttgctgatcgtgtacaaaatgatagtaaaccatcgaaagatgcatttagtcatatattcgatactattcaagattatcatgatattattgataaatatgaattaaaaaatggcttgattgatatagagactgaaaatataaagcaagcatataaaaagttatatacataaaggggttaggacaaattaatgtcttaaccctatttttttgctttattaaagccgaacatatgattgattatgccaattatagcttccctttaccccacataaaatatgatatgctcggcgataagacagtgttataaacttacaataacagtaccgatttagcacagcagtataattagctttttcattcccagcactacaatatccttcaaatcaataggtggaatcttatatcatcgaggcatattatcatatgaagtcacataatagaaattatctatttttttgactttaaatgttcctcccatattattaggctttccaataatactttgcgttatcatgtaataattgcattcatcattcttttcaatttcttcactatgaacttcttctattttcataaagaataccttatatgttgaatttatattataaacatattctgctattgctttttgtggtgttgaattatcaaatagattgcttatataattagtgtacaatttcagcccgacaaaaaatataattataacaatcaaaatattaaatactttacttctcaacaatttctttattttttctttcattagaatctaatccttacgtatgttccagaggtattttcccatccatttactgaagaacttactttagcacaatagttacttgtatgttgtgctattgttacatcataatatccactagatgttttactcccagatgcaactacaaaagcaacatgattatatcgtccatccttctcccaatctgctattataaaatcacccgcctgcaaattacctgagaatgtattaaagtttcctgatgcatattgactattacttctagaataccagtatgtttcaaaattatgcgcagctgaccaagaggctgtatatggtttccatgtagtatttgttggtgcaccacctgaccttagaatctgcgatgcaaaattagtacaatcggtactatatgttgtatagcttggattaggattaacagcatatttttttgcgtaacttactgctgtgcttttattaaagttaaatgaagcagctcgtgtcataggcaactgattaatagtatcaattataggacttgtgtacggtaagtaattgattaattcaaaaatatcgacattttcctgattacataaaatcctagcttgactatttatttcatgattttcacatactgtgaaaaattgatttaagatatttatatcttctatatctccactagcaatattatcaaaatacatttctttaaatacattaaaatattctttccaatactcctcctgattttaaatcaacaatattttctaataaattgtaaggagattcactataaatattacaatctgcatctaggcttatttctttttccattgcagttacagtagaaatattagttggaaatattcccactaaaaatacagcaataattaaagatacaataaattttctactctttttcataacgtatcttcctttcatatttgttgaaaacgtttccttaactatatgatagcactttatttacatatgtcaatagctacatatattttatatgtattgaattatcgattatattgtgatttaattatattaaagataggagatggattaatgagcagatcttcaaacaatttttttaggatggaaatgttgctgttaaaaatcatagaaatcggaaatggcgaatattatggttataaaatagtccagcagcttcaggagttatctgatgataaaataaagttagctgaaggagtcatgtaccccatcctctatcggcttttagacaaaggttatattattgatgaaaaaaggcttgttggtaaaagaaaaacaagagtttattataagcttgaaccaaaaggaaaagaatatcttaaccaactttacattgattacatggatataaacactagtattattaaaatcatggaggcaggaaatgaataatgttgtcaaacaatatctaaaggaatgtagacgtacatttccatttataagtaaaaatgaaaaattattttttaagcgcttagaagataatttgaatgatattgacgaaaacgttacttataaagaaatatgcttaaaatatggcgaaccaaaaaatgttatgatttcttatatagaaaattgtgacaatgaatatatcttaaagcgaacttctattaagtccattgtgaagaaaatattcattaccctattttgtattctaatagcactatgtgctacacttcttatttataatcaattgatatacaatgcatatgatgattctaatactataaaaaaagtaactattattgaggaggagtaaagaaaatgaaaaaaatatttgcaagttttttaactgttttaacactattaggcactacacctgtatttgcattaaatgaagaaagcaatacacagatagtcgaaagatttgaggacggtagttatatcgaagtgacaatcgaagaaataccaacgcttacaagaagtaacactaaaaagggtaataaaacaacatactacaaaaacacatatgatgtaatcttatggtctgtcaaaaccagtggaacatttacttatgatggctcaaccgcaaaatgtactgcttcatcagttgacactcaatgtccagctataaattggaaattgagtaatattagatcatcaaaatctggtgcaagcgcttatggatatgcaaccgcaaaaagttataacggtcttggaatggttttacaaactataaacgaaacagtaaaacttacttgcagtccaagtggaacattatcttaaaacaattaaaaataggtataacatcgaaaattaatctttttgaatgttatacctatttttttgcactattcagttaattcagtttcaattatcccgtgccagcaggtgtgatttttcggagcggttctttcgggtttgacaactccaagcatctgataatcatatttgcttgtattgcatcaataaaaacctcatcaattgaataaacatgaatatcttcagctgaggtgtattttaaatatacttcgtagatttttttactgtaatcaatataaaatgccatcctcggaggggcaataatgaatcccagttcaagacttgtgtcattttttaactctgacaatatgtgattttcctctaaactccctatatctgttatctttttttctttttctattgatttctttgactttttgaactacttcaaagagccttgctctaccgccgataccatactgtttaagagaaggagaaacagccaaacagatcgttttttctgttttagttgaatcagcaaccaccagattggtattcagtggatctaattctctttctacacattctacagaagcataaaaagactttaaatctatagccatatatatcctgtttcctgcactcatcattctcacctcaactgcctttaatttaattattaacacatcattagtaattaaactgattccaaaacgattataaaatttaaaagtgcgtaattcaacgaactacacacttaaacattaattatttacttttaactgacaaattaaggttttcatatttaattaatacaactgctatacggagtatatcctgcatctatagtcttctttgtcttctttcactattaaatatacaatataccaaaagaatcacattatcatttataggatatacatctaacccattccatgtactatatgatttatgcacttttctatttatcaatattaataaatctctctacggtcccctcaaattcattatccatataaaccacaatgtcactatcagttcctgataaagtatctgaatagtaatggaaagtcaatctagctaataaaatttttaaaaatagataattttagtattagtatctatattattgtcactataaaaattaacttcttctatgaggacacataaaaccgctgctccataatttttgaacacttctctgtatttgctttctagattaatactatcatctaccttctcgatttcaagacttatatcatttatcaattctagtgaatacctcaaatcatttaaatattctttaatcctatactctttgtccgcccaaataaaaaaaacatttatacaaaagtctttgccaagatgtcccaagcgtctatatatccgagttatcattattttttagaaataaacaatcattaccttctaaaaatatttaaattaattttgggttactaataactttcccagtggtaagcacttttcgtatttgccataatatcttgttagatgataaatataaattttctcaattctcttgatttcttttttattaatccattttcaataaaatgaaacaacttagtaaaatctacttatgttcctttattcatatctgaactatcatatattttcttcatttttaaaatccacttttaataaattaaatacttcagatagatcactttccattgatatagcattttcataccttttaaaattgctaaaatataatcagcttttttaatgattattccaaaagattgtatttttttcttttcccgcacccatacagggttataagatacctgttgaatacagactgttctcatgaaaattgtcctcactttcctctctagtattaagcctttttctttcaattaaaatatctttctttttatatagcaaaaaaacttatttcattaattataatgaaacaagtttttttagttatttttactttattaatgatataaattatactttaatatttcagggaggaaatattaatagttattcatctcttaaaattttgctacctaatttggcatgaaagctagcatctttagttgtttgtatatcaataccttttaacgccgatactttttcacatatcataaataacaatattatatattcaaaagatacaaagtctttctttttcaaactatttacataaaaatcttttttatcagttaattttgttccaataataacaatattatttgtccattgcgataatactgtttttaatgtctccacccttggttctacattagtatctaataaaaataaataggaagaatcattgatagcattataaattccatgtgtaaactcttcaaattcataaccagatactggtactcttaaagtttctactaattttaaacttccttctaatgtaatgccaaatacatctttggttccaactacacgaatatcttttgcctttaccaatgtctttccatttttttgaatccactgctctgcatcatcaacgatgcttatgagattattacttacattcttatagctttgtaagaattttttatatgctgtttgatcaataattccatatgtttttgcccaatacactcctagtaacattaagttagcaatcgtacataacataccttttgttttgggttgtaaatccccttcttctccacatttaactgtcagtatataatctgcaacttcatttaatactactgcattatcatctctacccgacatagatgctatatggcatccgtgtttctttgcccttttcatagcacgatatgtacttaaacttgttccactttgcgatattcctattactaatgtagtttgagaattttgaaaaatataagattctatttcaaagggatataagacttctactggtatttgcatatactttaacatacattctttcgctgccactccagcatgataactagaaccagaaccagtaattataattttttgatatctattttttacaacttctttaaataagttctggtgattttctactatttccatcattcttatgggtgtttcacgaatacattgttccattgttaacatagttacttttctccttacaaccttctttttaacctaaaattcctaaatatgcaccaccaataccaataattgtcattaatacaatcatagtaataggttttatctttttaataacaattccccaataagtagttgcgaatactaacagtgaagctaagcatggcataatttgatttaataaatcagatactgtttggctattagcaccatcgctgaacgtatacacaatattgagatttactaaactcgcacacattcctcctactacaaatagtccaagtacagtagctccctttaataaaacgctcatcaatccatttgattgcatttctgttaaaaatttagttcctaaagaatatcctacattcattaatccaatacgaattgcaaaagctggaatattataaattaagaagaagagaatcggtcctaatatatttccttgtagggcaaaggtggtccctacagccgttgcaataatcttgaaagtcccccaaaagaaggcatcaccaactccagatatcggtcccattaatgctacttttgtttcattcactactttggtatcaaattctttatttttagcgatttcttcctccatcgcagaagcaattcctaagttaaacgtcatacattgattagttacattataatactcaagatgtctttttaatgctttagatgcttcttctttttgtggaaacagcttacgtaatacaggaatcattgcatatgcaaaggcaatatttccttgtctttcatatccccatgaaaaagagcagccacaagatctcaacattgttttatttaattcctttttcgttaatttagaagtcatcatttattcctccttctgttatcgcagctgtttctgttttattaatttcctgtttaataagaataatagctaatactgttccaaaaatagctacccctaaaattggtagttgtgaatacgcaacaactgcaaatccacaaatgaaaatataaatatttgatttagataacatagttctagctaacatactaaatccaattgctggcaataaaccaatagttacatttaatcctgtttgtacaaactcaggaatagcattcaatatatcactcataacatcactgccagctgcaaatgagacagttactaaaactcctaaaattgctgccatcgttaatccgcaagtccaatgcaatatctctatgcctctgtaatcaccttgctctgcaagtttatcggcacgtctttgaaataaagaaacaatgtacccataatgaaaatttttaaaaattaaagctaatgaagcaaccggtaatgctaaaaccatcgcactctctgcacttgctccagcattaataacaaatgcagttcccaaaatagtacctatcatagcatcaggtggaataactgccccaatagaagtagcccctaaaaatgctaattccaatgttgctcctatcacaattccagttcgtaaatctcccattaacaaaccaactacagttccggccattattggttgtgtaataaaatttctacctccagcatactcaataactataagagccgctgttactagtccaagaattattgctgttccaatcattttattctcctctctctcattttaaatatggtatagccttaacttctggcacacgctgtataaatatttctactcccctacctaacatctgttgtaattgtttttcttcttcaggcaatacataaaaggttttagctaattgttttcctccatcttttaccttggaattccctaaattaatctttcggatattttcacatccttctaataatctatatgcatcttctacagtttcaacaattattaatagtcggtattgattcgtaacaccactgttaatagcctttatagaattttctatatctttcatgaccagctttgttgaaggtggttttgccatataaatagctgtcttcttaagttcatccttcataattccatcattagcaatcaatatacagttagcgtttaaatagttagtccaactataagcaatctgcccatgcaacaagcgatggtctacacgcaacattaaaatcatataatcttcctcctctctttaaaattcatcattttgatatgatttttttacaatatcattgcaataacatatcatttgtttattttcttctaataacgcatgtatttgttcttcaatacttctattttcattgataatttgtaaaattaatgacatattcattcctgcaatcaaatgaaatacatacgtatttaatagtctaataaaactattattaacactaccaccatatatatcagtgatgacaattacttcatctccatcattaaaactttcaaatatttgtttaacttctgcttcaaatgaaaaatcttcttttgtatatgctgatatagtataaatgttattactatgtcctactataaaagtaacactatctttcataccttctgctaacattccatgtgaagctaaaattattcttctcataaattcctcctttatccctactattaaaattcatccgatcctacctttacactgatatcattcttaatgtattcgtacaaataggcaatctcattaattggtaaagtaactttataatgttctaaaatagacgcaaaacattcatttaccacctcaataaattcactattagaatttataaatccaggaatatcataatattcttctactgtttttttcgttaccaaacgttcaattaaaaaacaaatgtgcatattgattcccacaattgtcttgcttagaaatttgcgttttaatcgatgctgcaaagcgttagttgcctcataaacataatctagtaacttttgagcatttaatattgttagattttccataatagattgcaatgagaaatttttaagtaataactgatcaaattgttcaatttctttagtacttaaatattctgctaaaatctcatttaccatattaatattctcaaagttaataatttcttctaacgtcacatttctaacaccatctaattgtaagttcattggttttactaatagttcaacattatattgaacaaaaatagtatcctttttaccattttgtaataataattcgtagtcataagcaatcatttcaaccgctattgtttttggtaaactatctttaaataatcggcatagtttctctgcaatagatattccagcatcactagtaaacaaaattgctttatctttttttgcaatagaaatcatatgataatatactttggcttgtttacttacttcttccaatattgtttgtactttctttttttgtttaatcttatttccaatttctaaggccaatagcgtggaaatattattaataatgccaacatttgcaaaaccctcgatttcttttcctatttcttctaaagaacccatatcaaccattaagataatatttttgaaatgcctattatgttgaacaaacatatttagtttttctatcgtatcatctaccgaactatagatgggcatatcaattgcttcaaatacttgcatgtttagtaaagtatttactgcatctgcaatagaacttgccgttgaatacccatgacacaaaacaactccgatagtatctaacatttttgtgttcaagttatataacttcatatttaataaaataaatgattgttgaatcatagaaagagaaatacgataattattagtaatttgtttattaagcatcttacaaagctgttccgattcatttcctatttgcaataaatattcatataatctagttatctctgtgatatgctctttttcccaaacgtttaatccagaattatgattttgttgaaaaataattaatctagctagaacataagcaaaattaataggaaaattaatgatcgtggaacttcttactgtagttaaataatttgtaacgaatttttccaattgtctaactctacagtcatcgtatgtttcctgaaaaacaataacatcatagtagtgtttaataatcttcttactttcttctaaaaattctttctcacttttgcaatttgtatttaattgttcgaatgaatgaataatattattccacaatgatataatttgaattatcgaactatcaattttaatatcctttaacggcatacatttttcttcctcactggatatcttaactgttgataacatataatcaggtaaatgaaatacatatatatccaagttctcattatcagaatcaacataagcatttgcacaaatagacttaacgcatttttttagttctgttaaattgttgttatacgtttctctaattaatgaatataatagcttattagatatcgaaatatttttacctaaacactcctcttcctcatagaaaaaatgtaaaataagttcctttttttcatcttcatttctttcagaaaatgatggaatattgcatactacaggaattcttgattccaaaatttcacacatctgttctttttgacttgggatactactcagaataatacgaatatccttatatactcgtttctttcctttttttcgtaagaaggattttgataataaaaaatctgctaatttttcttgcgtattttctggtaaatatgatacattttgaatgtataaaattccatgatctaaagtatccataattccttctactgtttgtccgttgatttctgttccaaacaaaaacaaatcataatctatttctttttgttgctttgtaactttaaggtatttaaattgcgcatttgatggtattatttcttgatttatacaatagtgataaataatttcccctagatattttttccctgttccattttccccaactaacaatatgggtaatcctcctgggtatgcgattgcagatttaatttgttgtattacatagtgcaaacttccatccttgcctactacattttcaaaatccatcctaatagaatctttacatttaagtatttggcgcaattctaacatactcatatattcactttgtcttaatgctacatgatacttcttttccaaaattattttacttaaataatacacaggccttgaagtaatttttatagctgtgccattttttaccatatcatttaagtacatagaaactaaagatctagacagatgtaatgtctgacttatatactttgtagtgaaaatatccaaatttttattgtcaaattgtttcgttatttcatctaaatatttaacaacctgatgtttagaactatattgcgccataatttcacctcctctttcttatggctaaagtatattatatatttttattatgaactgtagttacaacctattttgacactatttatgcttaaaactgcttttttaacacttaattgtcctataatggcatgtgtttatttttatttacactatttcatagtgtaaataaaaataaacattgtaataaatttgtggtaatctatattttaataaaggatattataatgcggttgaattgacatttccgacagatgtaagagaatgtattatacttattggtaaagctacaattggaaatgttgtaaataaatatttcaaaatatttttccaattaaattaagaaagtgaattaggaatatataccgattgtgttctctttgtattataatattcaatatattcttccattgcaatcttatatgccacctatatgaaattatatttgatttgttttttcatgaaatatggatacctcttatttaattgatctttttttataatataactttataaaaaagcatagtgagtagctagtaccatacaattactactcacttgatttacttcgatccagaaagattaaagtagaattatcaaagtcaggatatcaagttagcgttcgaaaaattcgtcgtattatgcaagaaaatggcctggtttctaactatacagtaaaacaatataaaatacataagagtacatgcaataatgataaagtagaaaatatagtacatcgtgaatttgatagagaaaaaacattagatgtagtagtaagtgatcttacctatgtaaatgtaggtggttattggaattatatatgtttactactggatttatataatcgagaaattattgggtatgcagcaggtaaacataaagatgcaaaattagtatataaggccttcagcagagtacaaagaaacctgaataatattcaactatttcacacagacagaggaaatgaatataagaataggataattgataaagtactagaaacatttaatgttagtagatcgttaagtgctaaaggatgtccctatgataatgcagcagctgaagccacctataaaatcataaaaacagaatttgcatttaatagaatatttaatagttttgaagagctggaattagaattatttgattatgtaaactggtataataacattcgcattcatggatcattaggatatgtatcaccagttgaatataggataaattctctttgaaattgtcctaaaaagtgttgacaatccaaaatgcgacaggttcaagaaatgacttactttacaaatctgcctaaggaggaatttgaaaaaagaaagatagaagatttgtattcaaaacgatgggatattaaagttgcgtacaaaacattaaaaactcaattagaacttgaaagaaatgtatcaactaatgtttaagttgtacaaacgagtgtatatgcaaaagttttgttttacgctatatgtaattgagttgaacttaataattaaaagaaataagaatttgacactctcatttctttgtttctaaataatctataatatctataagctgatcaacgataaattgagcatgactttgacgtagttaatgcataatgtataagttgttgacttgatgatgatgcaagtgctattttgtagttatgtaactttaaatagtcgagtagggagaaaatatatggattgagtatggcttggtaatctctttttaaagaggcataatacttagttaataaatcattaaattcttctcttgaagttttttcattccaccagccatacacaatatctctaaacttacgattatcaacacatatcacttgtttatattcatcaagtaataaatcaatgtcatattttttataaaatgccataagttcattcatatacattgtttcactatcaaagataacaccgtccatatcaaagataacagttgttttatgattcatgattaataatctaatgctttataataacgtctaatatcaattggatgacgtctacaatgttctaagtgtacatttaatctcataaatgctgatctcatcatgataggagataaaattcctctaaactcatcacttattccttttaattcataatcttttgtatcaaaaacagtaacttttgcactgactctatgaacaaagttttctacacgatccatttctggacgagttttatcttcacctttaatcaaaataactggaatatctctttcaataacttctaatgttccatggaagaagtttgctgctgaaattggtcttgttcgcatccattgcatttcttccataatacacataccatagcacactgcccaatcttctaggtttcctgatgcaactaaataagtaattggttcatcacaatattgttttgcgtatgcttccattttagcatcagcatctttataaatttgtacaacattttctggcatgtttttaatctcattcatcaattgatcatatttatcaaattgtcccgcatttttcataaagcgtaatacaactgaataccaccaataatattcaccaccgaatgtatttactaaataatcaacttttttagccaaaggagaatttaaaacttcaacatatcccataactttggctcctacttcatgtgctttatcaatagctgcttcaatttcaatagtattacctgataatgatgcaataactacaattgatttttcattaaatttagcattcccttcatataagaaatcagttgcattttctagataaattggtaaatcacaaccaagttgtttagcagtatgcataatttgtcctgcatacaataatgttccaccaattccaaataagaagatatttgaatacccatcttcacaaactttatcaacaattttttctacttcagggattaaatttactccattttgatgttctgttcttactctgctttcatcgaaatttaacatttttctctttgattcttcaactatttgtattgctgatgatgcacctataacgtctgctcctgatttgaaaaatttttctgcttgttgatatgttcgtattcctccagaagcttttatgcatatattatcatctagaatatttttcattagtttaacatcatttaaatctgcgcctcgaaagcttcttcctgtcgatgttttcaaaaaagtaggttttacacgattggcaatattacaaatttctctttttatattgtctctaccttcaagtttacacatttctacaataactttttcagctattccatatttctggcatatttcatgaatagaaaacatttcttcttctattttttttagatttccattttcaactgcattttgatttaatacataatctatttctttataccctattaatgcatattctttaaatttattaactttttcttctaatgttaatacaccttctggaaaatctattgcaccggcaataataatatcatcattcaaagcattcacagcatattcatattcttgctttgttctagcaaaaatacagcgaaatccatatttgtttgctttatccaaataagttttaaaatcatcttgaggatctcttatatagtctaattttttagcaatatttaacatatttctttcctccacttatcaaataaaaattttgattttttatctgcttcaaaaggttttctataatacacacgattaacaatttcaaaagaaagcaatcctgtatagttatatttttttaatgtatttaaatcttgtgacatgcatcgtgtgccatctccccatgccatatgaccagttggattcccatcaacaaaatgacaatgaataattctacttccaaaagcttcaaaataatcatttatattttctttagcttttgccattgctcctaaatctaaacagatttttaaattatcatgattaactaaatcgagaaaatcctttaagtctgaaattgtattcaccaaaattgattccattggctgtaaagcctctatcgctaaaggaatatttttagatgctccatattgagccaaacgattcaacatttttgcacttctttgttttgcatcatccttattttctaataaatacgcccatccactagtaacaacaacttgattcgcatttatctcataagcaatatcaatcgcatttttaaaataggcaaatactctttcttgttcttttgtagatttagcagccatattattcggttttggatttgtttgttctggacaaacaccaattacttttaatttatatttacgttccaattgtcttaaattttcaactggatcatacccattataatccaaataaaaatgcatcggtcctgtccaaagttcaacatattgaaatccattttcgaaagactttttaaaaaaatcttctaatgtataaaaacgataatgacaattcattgcacatacatccatatatatctctcccttttcatttgtaataaatgataatggcaatatggtataggtatacataatgccattatccatattatcaatgtattaataattcaaagctttataataacgtctaatatcaattggatgacgtctacaatgttctaagtgtacatttaatctcataaatgctgatctcatcatgataggagataaaattcctctaaactcatcacttattccttttaattcataatcttttgtatcaaaaacagtaacttttgcactgactctatgaacaaagttttctacacgatccatttctggacgagttttatcttcacctttaatcaaaataactggaatatctctttcaataacttctaatgttccatggaagaagtttgctgctgaaattggtcttgttcgcatccattgcatttcttccataatacacataccatagcacactgcccaatcttctaggtttcctgatgcaactaaataagtaattggttcatcacaatattgttttgcgtatgcttccattttagcatcagcatctttataaatttgtacaacattttctggcatgtttttaatctcattcatcaattgatcatatttatcaaattgtcccgcatttttcataaagcgtaatacaactgaataccaccaataatattcaccaccgaatgtatttactaaataatcaacttttttagccaaaggagaatttaaaacttcaacatatcccataactttggctcctacttcatgtgctttatcaatagctgcttcaatttcaatagtattacctgataatgatgcaataactacaattgatttttcattaaatttagcattcccttcatataagaaatcagttgcattttctaaataaattggtaaatcacaaccaagttgtttagcagtatgcataatttgtcctgcatacaataatgttccaccaattccaaataagaagatatttgaatacccatcttcacaaactttatcaacaattttttctacttcagggattaaatttactccattttgatgttctgttcttactctgctttcatcgaaatttaacatttttctttcctccatttattttcttatcctaaaattccaaattgtgcacagacaataccaataattgctgtaccaataattagccataatacattaacctttttttgtagaagtttataataaatacctgttgttgccaatgctaacatccctggcataattccatttaaaatatcctgaatttttgtagcgctttcgccacttccaatgactagaggagtcgatactactactaattcatttgtcattccaccaataaccattactcctaaaattgctgctgctaacatgaatttttccattaatccagaactttgaattttttctaaataagttgctccaagttcataacctttcatagcacagatatatcttaaaacgaatgctggaacattgaaaattaataagaataaaattggccctaaaatatttccttgcattgctaaagatgtccctataccaattgctaatactcttaatgtcccaagtaataatgaatcaccaataccacttaatggacccattaatgcagctttaacagcattaattgatgatgaatcaaaatcttcttgtgttgcattcatttcttccattgctaaagtaatcccaccaacaaaagttgaaacatgtggtgttatattaaagaactctaaatgtctttgaagtgcttctgatagtcctttgggatcatttctgtatatcttctttaatcctgcacttatcatactacaaaatcccatgtgcatttgtctttcgtaatgccatgaaaattccattggtaacgatctccaaaacatttttattaaatctttttttgtaataactttttcattattagaagtcttcgtcatcttcatatcctccttctgccattactaaattattattatttttaaaatcaatctttaagaatacagcaattacaccaagaatagcaattcctacaactggaattttaaaatatgctgataaaacaaatcctaagaagaaaaatggaataactttcttattcataatcatttgagctaacattgcaaatccaattccaggtaataaaccacatgcaattgataatccatcagtaataaccgcaggaattgcattaacaatagcttccatttgtgaacttcctaaggcaaatcctaaaaaagtaatcaaaaataatactgaacatgtaataaaaccagttcccatatgtactatagttattgctttagcattacctttagcagcatatttatctgcaatttttgccataaatggtcttactaaagaaaaaataacattgtcaattgcttgagctaataaagcaattggaaaggccatagtaaaagcaatttctgcacctttacctgtagtaattgcaaatgctgtacctagtactccaccaacaataacatttggtggaatatatgcaccaacggaaacttgccctaaaaacgctaattctaaagttgcacctacaacaattcccatttgtaaatcccctaaaatcaaaccaaccaatggaccaagcacgatcggtctttgtattaagtttgtacctgttgctaaatcacattttccaataaatgctacgcaacctaataaaaacgcctgtaacataattcttcttcctctctatataacatcttttgcatcaattttcttgtcggttggaaccatacgaatttctacagaatactctttattcaataaatctttaacaagttcaatttctttttctgttaaattcactgccttagaaatattctttgtttcagcagtagccttagttccacccaaaacaacactatcaatcacatgagtttcagtcattaaacgatatgcatctttaacgctctcaacaacaataaatagtttgtatttatctgttacaccactattgattgactgaatggcataatcaatattttttaaaaccaactttactccttgtggtttggccatcttaatagccatttttttcaattcatcttgcataagtgcatcattagcaatcaaaatacaatctgctccaagagcacttgtccaagagaatgcaacttgtccatgtagtagtcgatgatcaactcttaaacatttaatcataacttcttccccttttactaaaattcttcttcttcaatatctttttttaaagttacactattttccaatgtgattcctacttttccactatctaatacatgatcaatatttacatttccggaattattagatataaccaattcaagaaccatattcatattcataccagagataagattcactctttcattattacacgtctgcaataatgcattataaacgctacctcctttaacatcgcatacaatcacataatcttttgtatctgcttcaattctcttttttaaagaagcagcataatcatttggattttcaccaggatataaactatatgtttcaatatcttttgcaagttctccaacaatcattgaaactgagtttaacattcctttagataaatcaccatgtgatgctaaaattatttttaccataacgtccactcctttcactgattaccgagcaagaagcgtgccaaaataataaatgtactttaatttttttatttttttgttgaagttaccggacacttatatttgagcaaaactcgtgccaaaataaaaatccatataaacctattttgtttatatggacatatattaatcattttctacataagagtaaatatattcaatttcttcagttgggatttcaacattatagaattcctcaacctttttcatagattgttttaaagctataataaaatcttgatgtttctcttcaaaatcctcactattatatactgttatctgttgtttcatgattaatctttcaatcaagcaactgatatgtatatacaagccaaagcatgttttatttttaaattgatgatttaatattttttgtagttcatctaaagcagtagaaacttgtttaagaagtttgtttggatttaggattgttaaattgttcataacattcgataacgagaaatttttaagaatatttttttcaaagataagcagttgatcatttgaaagataatctttaaaatactgctctaatttatcatgttcactattaataataaaatcttcgattcctataaatggtaaatcactcatattagggtttaatgttcctacaacacatacgatattgtaatcttctaaaaattggcgatcagtatgattttgaataagcgatggataatcatatgtcaaaactttcatatttaatccttttggtaatgaatcggtaataattgttttcaatttttctgcagcaccaatgccactagcacaactgcataaaataattggttctttttggtgatgaagttcaaggtggacatgataaggattgtttttgttgatgtcttcaaaaatgtcttgcatagagcgttgttgtttaattcccatgccaatttctaaagcgagtttggtattaacattgtttatcatggctatatctacattttttatttgtattccttgatatatttcttctaaagatcccatatcaaccaataaatataaatgtttaattttccccatataagataaataattattgatcttgttaataattgtcgtgctatccacatttaacggcatatcaatagcatcaaaaacatatgtatctaataatttatttgctgattcagcaatagaacttgcagttgaataaccatgtgccaatataatcgcaagtgtttggtttaatgaatcatgattcatatatttatttaaaataatcatcataatgacttgtaccattgcatcataagcatcattgatattattttttaaatagtcatagacttcatctgctattaagtattctctatgaaactttgcttttaagttttcttgaaaacaataaatggtttgttcattctcatttacccattttgccagtttataagtattatgattatattccaataaatagcttgtgagtgcaataacctcattatgcgacattttaaaaccatagcgattcgtcatcatgtctaatacatgacctacagtatctaagagatagttattttgacttaaatcttttttatcaaatacaattttttcaaagtaatcttcaataagttttcttgattgtgttatgaaatcttcttgattatgaagatgaattaaattttcataaaaatgaatagtacgattttgtaaagatgttggaataagtgtatcgagtgataacatttgatgtttcttcatcattaattgtgctggattaaccatttccataatagtttgaggaaaatgataagcatgaatttctagtttatcatcttggcaattgaataatgcactcacacaacttgattgaatcacattgcttaattccccaatatttcctataaaattatgatttaatagaagctgataaacattagaagaaatccgaatcgttttctttatccttttttcttctttatgataaagggaataaatcaattgtactctttcattaacccctctttgtgataaagagggaatttgtaaaataacaggtattcttcttaaaagtgtttttaaaagaacctgctctggatcttctgttgttgcaaaaataatacgacaatgtgagtgatgccatttatcattatcacccatcatatgataaattccttgatccatgtataaaaataatttttcttggcattccgctttcaaacaatgtacttcatctaaaaataatactcctccattagcataatgaagcaatcctaaattatctttatctgcacctgtaaaggcaccacgcttatagccaaacaaattagccgttaataactctggattgtttgcatattctgaacaattgacttgtacaaattgtttatctttttcaatcaatctcttgtttatacaatattcataggttagcttagcaaggaaagattttccagtacccgtaggtccatttagtaatattggtaatcctactggtggatatgatactgttgctttaattttttcaacaagatgattgagactatcgttatatccaatgagtttttcaaaatcatgtaaaatatgttcattttctaattccataagtaaatcttgtaattttgagtattgctttttcaaatgctcttttttatattttgtttgcagataatctttatctaaaaatatgattggtctttgttttattttgatgaatacatcttgttcatataattcattacataaggtagaaacataattacgactttgtttgagttgttgagatatttccatacaagtacatttatcaaatgctttttgatcaataagttggtgaatacaatctaatattttcttttccatgatttcatcttcctttgttgttatcttaatcatttcaattatgactgtcaaggtctatttttttgttctttttctatatattttggcacgaattttgctactatataggtagaggtgattgtgatgaagcaaaagtttagaatgaaacaaacttataaacaaacttttcaattaaatcaaaaaatgattcattcccttgattttttaaagttaaacagtgaagatatgcaaagtcttattgataacgctttacaaacaaaccctttcttagaattaaggaaagcatatgatccttcaaatcattcttacattgaaaatatttctaatcatccttctttacaagaggaattatatcaccaactttatgcttgtttaaaatcttatgattctcatattatgtcttatcttattgaatctttaaatgatcgtggatttttaagttatagttatgatgtttatttaaaagaattacagattgatgaaaatacattttttaagcatttagaacttttacagtcttttgaacctgctggtgtcgctgctagtgatgctattgattctatatgtattcagttaaagagaaaaggcaaggaaaatgcatattgtttgatgaagaaatacaaagatattattcttacgcagaattatcatcaaatcaaacaaacaacccatcttacacaaagagaaattgatattctttttgaagatattaagcaatgtcagccatttccatgtcaaaattattcaaatcaaaatgatatttatgttttaccagatattgatattattattgaaaatgaaaatattcaaattgtccctattaaccaaccaaatgtgatggtaaatgaccatctctatcaaagtgttagagataacgaagatatgaaaaacttttttaatgaagctcattttcttttggaaaacttaaccaaaagaaataagactgtcttaatggtagctaatgaattggttgacttacaaaaaagttattttctctataatgatgaattggtttcttgtacgttagctgacttagcacaaaaatgcggctttcatgaatctacgatatctcgtacacttcatcataaatattatcgttttaataatgaggtttatcctttaaagaacttattggtatctaaaactttaagtggtgatagtagtgattctatcaaaaaggcaattgtcttattaattcacaatgaagataaacaaaagcctttaactgatgaagccatagtttctaagttagaagaactggatttatattgttccagacgagtgattgtaaaatatcgccaacaattaaatataccctcatcttctaagcgaaaaagaaaatagtcttttaaagtatttaaaaaatgccttttgtctatcaaagaacacaatggggtcaacttaagaaatactttgtttttaacagctctaacaaacataataagacaatttactcgcttgattaattctttttctaatattattcatttcaaaatcgttaataatttatgtcgaactcgttttcaggattttatcggaatacgtgtcatgacttttgatatagttgttttctaacttatattcagaaacagaaaaaatactgatgcagatcttattaaatttttctcatgtcttgatatttttgaaaagaagattaccaaacaggctatgcataagaatatcagaaaacttaattcaaatgttttttcattattaatttaaacagtttgctcaattattttattcctcagaattaagcttatactatactataagggttacacacttctcggtggggacggtactttttagaaatttcatatgatacctataatatcaattactttggcatatggtaaaaccaaaatgtttgtgatatgtttgatgtgaaaaagattgtttccaaaccagctggtctatatgatatcactaatggcatttttgttgatttcacaacaaaaacaggcaacccattcagaaatgccacttgcacttcaacatttatatgctacaagtgatttgtacaaagatatgaaagtcatatatttagctgataggtgctatggctctgctgggttgatctgtttttttgattatcttggatattattactgcgttagaggaaagtcatatttttacaaaagccaaatttcacagatgaaatcaaacaatgaatatataacgattaatattaatgataagtggcttaagagattttcattctctcctgaggcaattgaatatagaagaaaaaattccgaattaaaaataagagtcgttaaaagaaattacatatattatgatgagctagaaatgcgacaggttcaagaaatgacttactttacaaatctgcctaaggaggaatttgaaaaaagaaagatggaagctctgtattcaaaacgattggatattgaagttgcgtacaaaacattaaaaactcaattagaacttgaaagaaatgtatcaactaatgtctaagttgtacaaacgaatgtatatgcaaagttttgttttacaatatggcgggaatactaagaaaacaaattaatcgagaacttatgagtcatccaaaacagaatgaaacaaaagagtataaagaaaatgtaattgtatttgaatctcaatattgggttgtcaacatatcacagcttatcaactgttttatggaaaataatattttagtagcatgttcaataaaaacaagagagcgatagtgaaaagatatatcagatgttaaaagcatgtgagaaactaaaagtgcctattcaagagaatagacactttgaatgatgaggtcgagttgttccgagcggattttatacccgttttacacttgatgatcgaaactttccaacagtaaaaaccatcaatggtgtaatgaaaacaaccaaaccgtagttaaatattacacgataatcatagtacattacaatttcaaaaaaatgataaattttacatagggattttatgcatttttttacgtgttttaattggaaatatcaattgattaattatgttagtacaatggaaagaaaaggtaatacagatagcatatttacccactctctccttaaacgaaatacactactttaatgtattctaaatgagaaattaagacacccacttatatttgttgaaatagaattaaagattataataattgagcctgtaaattattttgtgtaaagtctgtttccaatgatagaatttgatgagtaactgtattgagtaattatacagttacttttttatatcatatcataatatatttaattgtaaatgttctcgttaaaccctcccttcaaagatgatttgaagactagaatatataattccccaattaccatatgggacattccatttacttgttattttatcttgagctaagtacaaagatttaaataaactttcatctgttgggaatactgttcttattttagtaaactttctaaatgttctctttctacacattctactatatccataacgttcttcgtcatataatcttataatttctttcttgtccatataagttaattttgccataataaaaccccaaagattgtacttgttatattagtccaatctttggggttcatttcaaacgaactacacacttaaacactaattatttgattttataaaatggattttaaactgtttatatccatttatttatatcgtttgactttttattcttgtagtttaattattcaaaatttgtatgtctttgaaacatactatctgaattttcgtttaattttttcattaattctaatataattgcatcataaacaagaaatgaaagctgctcaaaagcagaggccataggttgcttacttttaccagataatttagaagcacctggtaacacaactatactatcagccaaagaagctatagtagaattttcgtttattgttataagagcaactcttacctgttcatcttttgctgtttgagcaatagacacaagacttggcgtttcacctgatcccgatccaataataagtaaatctccagactttgaatgaggagaagtaatttctccgactaaactaactgaaaatcccagatgcataagtctatttgcaaacgcagaaataatcagaccagagcgtccttttcccaataaatatatatgatgagctttcactatttctttaataaaattttgaaaatcattatcatttactatctgactgttttgctttaattcatttaaaataatctctaaattattttttacactcatattttttgcctttctttaataaatttttaattctttctgtaatatttccattaaaaatatatccaccagacacaaacacattcactcccgtttttaaacactctactattgtttcatcagtgatattaccatcaacttgaatatcataataaaaattattatcttccttgagttttgctagttctttcattttgtgaagagttgagtttataaatttttgtccaggtactccaggattaatagtcataactagcacttgatcaacaagtgggagcatctctttaatcatgcatactggtgtcgcaggattaattgctacacctgccctttttcctaatgcatgaatcatttgtataactctataaagatgtcttgttgattcgtaatgtacagtaataatatctgcattcttgtaattatcaatatatctttcaggattttctatcatcaaatgtacatctaaaataaactctgttttttcttttaaatcattaaccgtatttgatccaaatgcttgattaggtacaaaatgtccgtccatcacatcaatatgtaaatatgttgctcctgcacttttaacttcttttaattgtttaaccagatcataagtatttgcatttaatagtgaaggtgatataatcattaaaatcatctccttataataaagggtatctttcgataccctattcacctaaaatcattacattaattattcttgttctttctcttaattgatcccaatcaacgaaatatactcgtcctaaagtccccaataatatatttccatcacgtataataaacgtaagcgaaggactgccaaacactgatgacctaatatgagcatctgtattcaacattgtccatttttcagctgggtaatttgaatcacttaaacttaatccaaattcaatatgttttggtcctggactgttatattgattttcacttgtcatcttaggtactaaacgatctaaagtattattaatatcaacttgtaaatactcgtcaccataaaaattagtatcatgcatagtttcatcaaaatataatgaacatgttgtatgtgcacttgaaactgttatcaacccatctttaatatttgatttttttacaaaatcaattaaatgctgtttaatatcgtgatatgatggtctacctataactgtctgaaggacaatatcatcatgataaatattcatactataaacctaatctttcttttaaatctttatataattgttctacccccaaacctgttaataaaggcaatccattaataaccttatctttaatagattcagatacaattgttgttgagataacagcatcataatcatcaattttattcaactcatcagctaatttagattgataaattttaacttctgtatatccattactatttaaccattcttgtacttttgcaactgcaattgtagaagttgcatgtcctgctccacatacgattaataatgttttcattcttttttcctcctattgtaccgcgggcttttttattttatttacataaattaatagtcccaacactataactccaataataactaatccaatccatccaattgattgtaacagtattgtaaataatgctacaggccataagccacagttaactgatgtaactaaaccaactgtaccaacattatattctgctaatttaaatacatttgtaataactggtgctagccaggttgacaaatataacattgtcaccatatataaactgcagcctaaaatacttctcacaatatttcctttaaagaaaggaaccattaatgcaatagcaaatgcataaaaagctaagtcgccaaatggtaatgttttattgcctggtaaaataattgctaataatagtgatacaggtaccataattaatgtagttgtcataactgtcggatgcccaacagtaagcgctgcatccataccaatgttaacagtacgaccatttaaatgcttatttgtccaagtttttgcggcctcagcaactggcattagaccctccataaacattgcaaccatttttggcataattttcataacagctgctgttgtcattcctaattgaccaattttggcaacatcataccctgccaaaatacctacacctataccaataaataatcccataataactgtatctccaaagataccaaattttttaccaattgtttctgcatctgcatcaattctattcagacctggaatatgatcaaataaccaattaacaggaattgcaaaaatcgttccacataaagccatcatatgtgtaatagcaataccaggatacccaaagaaattgctgattttctcttgaaataagtctgcaagtaaccattgaatcataagtgctactataattcctaagagaccaacccaaaaacttccactaattgcattagcaactaaccccaagaacgctgggaaccaaaaattccaaatatctacatttaatgtttttgtccaaccaagcataacaaacactaaattaagtcctaatgaaattagtataatacaaatacctaatgttgtagaaaatgcaagcggccctccaactccacaaccaatatccataatacttaatgagttaccatatttttctcccattgtttgaatagctgttcccaaatttgatgatagcaaaccaataactaaatccaaaccaatagaaccaataccaactgtaatcccagaaataattgcctttgataatttaaccccaaaaaataatgctataataattattataatcggcaggaaaactgttgatcccagaccaataaaccattgtaatgcttcaaccatttttttaccctctcttaataaattccatttctatttaaaatacccataaattcttcttcgttttcacattgtttaagtgcattaattgcttctttattctgaaacaatgcgattaaattttgtaatatttgtacttgttcatgcggttgactcatagctaacataaatactagttcaacttttattttttcatttttatctcccatgtttaaaaactcaacaggttgattcaatgatgcaaagcagatctgtgaataattaaccttgcttgaatcagtgtgaggaatcgcaaatcctatatcattaatcaataatcccgttggatattcttcctcacgttctttaattccttctaaataatcacttttaactacaccagcttgaaacattgttttgaacattgtttcaaacaattcatcctgagtagcaaatatttgatgaaacatacataatcttttatcaaaatacataaatttccccctctattacttataaaataaatctatcattgcatcaatactactaatttttacaatctgatctatatattccttcttaataatgatttgatatatttcttgaataacatctttaaacttatcaacatgatcttcatttaaacataccattataataagacttactagattaccaccccaatcgacaggtttatctaaagttagtatagatatactagatgtaataattgttgatggatcggcatgtggcagagcaactccactatccatacacgtaactcctgctctctccctattaaagattgaatctctaaatttttcattaacatattctctattttctaattcttgaattaagttttccaaacactcttttttatttttataattcttctttatttgaattaatgttggattaataaattgacttagatatggtgcagagaaatttttcaattctctgagtacttcttctttaaatagtatatgttttttatatgcgtccataatattgatataatcttcattggtaacaactggacttactctaacgtatggaacatttatattatctaaatcaactgacgttataatcaaatctacatgagataaatccgcaagatataatttttctattctggatagttcaatattatctttagctggcaatagtttacggactttactcaatattaattgggaggaagatattccatatggacaaacaactaatatattattagcttttgagatattaactaatgctatttggaaatgaacaagtattaatgaaacttcctcatcatttaaaataacattatatcttgattctattaatgataatgcataccagacaattgtaaataattctgtatactgctcctttatattctctaataaaggattttttattttaattccctttttcagtcttagaatcattgcaggaacatgataaatcagcgacttatataagtgcttatcttgtcttaagtcaatcttttctattttagacataacttcaataatttcgtttactaagtctgcatattcattttgtcctgtttttaaactatttgttattcgatgtgcaaataattgcctacataaatactcaatatccgcatttttaaaatatagatttaaattttgttgcaacatttcaacaatgctattcgccacaacatacgtttccatatagcgtatattattaaacaagaacgtttcttcagttttaacatgataaccatatttcaacctaacaatttgtataagaagtataacaataattgatttcagataataaatagatacatcatttgttaattcgttatagtcttctaataataaatggaaaacgtaatcaatatgctgtctatcaaacaggagttctaatttacttttcaaatccaataatgaatcatctttatcatcttcaaaaacataatcttttatagatttttgcaaatctatttctgtacctattgatacaattccaatattagttacctttagttttgtattctgtctttcaaatacttcattaatgactcctaaatcctgatataaagatgtcttacttactaaaaaatcatttgatagattttctaaagtagtatttttgttttctaaaagaatctttcttataatagaaaaacgtcgattcactggagaatactcatctcttttattttcatcactaatttcatctatgagcttattaagattgttttttgcgtccaataatttaatgccatttcttggcgaagaatcaagatctagaccattttcttgtaaaaaactgtagagagcatttatatcactatatatggttttcgttgatactgataaccatttagcaaagaaagatgcgggcttatactcactttgttcttttaaaagttttaaaaattttatttgtcgactattcattttctcaccccataagttaactctgtttctctttccgaatatatgataacatcgtaacaacagtgagggcaattacatatacttccttattaatgtggaaaatctacataataaatcatcgtacaatttgatgattatatttttattaccgttttaaaacgaaataaaaggcataacttccacttatgttggaaatatatgcctttatgcatagtaacgatttatcattagtataaacaatatcgcctttaacaactgaatcgtcaacaaacataaatccagctacttatactttatctgccgagaaccctttcgtacctccataatatatatgaggactttgaatgcttgaacctatcattatcaccctaacctttatactattaaaaaaatcattatagttctctaataacagtttttatttctatcatagtaagcgatttaaccatctttcttgtataataaaaatgtaccttgttgtaacatttatatcactttttctttccaacctttgtacaatgtagatagaaccttaatactcttatatttctatgtggtttatccacttatcaggagagtgaatctataggatcttattacatctgtttatagctcgatagattttgatatcttcatgtcacgcaaggttacactagtaagattgctatagaaatgacaaggtttctagaaaggcggtctttttatgacaaaactattttgcggtattgacgtagccaaatataaacacgtcgcaagtatctacaatctatctacaggtgaaataatacttgattcaatacattttgataataatgaccaaggttttaatacattattatcaagcttatctaaattgaataagagaaatgaaatattatggctttgaatcaactagccactatcaccaaacattattcaattttctaacttctaagaaatataagtgttatctgatcaccccttataagacaagtaagtttagatccatttctcgcctattgacatatatgtataaaatttcaaattacttcattaaaattatgacataaaaaaattacgtcatttttttcaaagaataagttgtcaactaataattatagtttatttttctttattcctgtcaaatctaatattaatgaaagaaggaatgatattatggcagttgcacacaaaagcgctataagcgttggacttatttatgtaccagtttcactttataaaacaacccgaaatacagctatcagtttcaatcaactatgtaaagacgagaacggaaaataccagcgtattaaatatcaaaagttatgtccctcttgcaattctgaagttaaaagtagtgatattataaaagggtacgaatatgaaaagggtaaatatgttacaatatctaacgatgaacttgaaagaatcaaatcaaaaactgataaaactattcatgtattacattttgctaaaatgaccgacattgatcaattatattatgataaaaattattacattgttccagagcctggtggtgaaaaggcatttgaactactcagacaagcactattatctcaaaagaaagttgccattgctaaaaccgttatggggacaaaagaggaacttatagtgctatatcccactaaaacagatatcattgctaaaatactattttttcaggaagaaattcaaccagctccaactattaacaaggtttctgttgataaaaatgaacttgaaatggctaaaaccttaatcaactctatgacagataaatttacaccagaagtgtatcacgatgaataccaagctaaattgcatgatgctatacagactaaaataaacggtcaggaagtagtagttgctgatgacagtcagcctaacagtgtaattgatttgatgtctgcactgcagcagtctattgatctagctaacacacaagcatcaaataacatggcagcgtaactatgaatgatatttttgataaacgtttagcaagaccaatgctaattgctaatcaatctgagccgttcaactcatcagagtatttatttgaattaaagtttgatggaatcagatgtcttgcatatattgatagaaaaagtgttgatttaagaaataagcgtaacaaagaactgattaatcagtttcctgaactttctaatattttttccaatgttaatggacaatgcattcttgatggagagatcattgtccttaaaaacggtaaccctgacttttacgaagttcaaaagcgtacagttataactgacttttttaaaataaaactcttatctgaaaagtatcctgctacctttgttgtctatgatttaatatatcttgacaatgacttacttatcgatataccaatagaagaaagaataaacaaattgccacgattaattaatgaaaataatcgtatatctatatcaaaagttatagaaaatactggtatagagttatttaatattgtcaaatcaaaagaactggaaggagtagttgctaaacgaaaaggtagcaaatatttctttgaaaagcgttcaactgactggattaaatttaaatatctggttgatgatgatttcgttctctgcggatatattcaaaaagacaacaatatgacaagttttatattaggtaaatatgattcaagtaataatttaaaatactatgggcatgtcaccttaggtgcaagtataagaacattagatcaatacaattacactatcataaagcaccatccatttaattgtaatctacccaaaggaaatgataatgcagtttggatagaacctaatttagtatgtatagtacaatacatgccttctaacaaagaaggtatgcgtcaacctgtttgcaaaggtattagagaagacaaagaaacaaaagagtgcagagaataatggttcctacttggttttagacaatcataaaattagaggattcaaactattgaatttatcaacagcatttaaatcctcctttttatttatactctaaagtaagaaataaccaaaataatctatacttttttattcaaatgttttaataacgttacctgatattctggttttttttatatttttttgtaatacttcttcaaaacatttttctaattcacttatattaaaatctaaaatcatagtcatttcatttttctgaaagaataattggtttgcactcttacatcattttatttatataatcaaaaatcacttgatttatatagttatctcctatgacatttttatttgaaccacactaccaaatcattagtatatattctatgtgaaatcttttataatgtaggcaacaagcattaaaactatatagctaagtccagctataaaaaactgatgacttaatgtatcactaaagtatgataatatagcgccaaaatatggagcaatgaaagagcctaaactttggaaaactaataatgttgttgtccctttattaccataaattcctaccttttcttgaagaaatggtacaaatgccatatatccataccctaatataaaagctgataataatgttaataacagacttctagatgctgaggctattacaaacgaaattgcacatatcaaataaaataatataagtgatttattcttcagcttattataaatattgccatacattgctcctgatactaaagatcctgcagatataaacatgacaagtaaagagccatcttgtacagacccatattcgtttaatattaacaatgtagaacacttaataacaaaaaatgttgctagagttactgaaataaaagaaagtactgcatatagaaaaattttactccaacatatttttgacccactatgttcattagaactttgaacatctgtaacatttggaacatataaaaaaactattaaaaaaacaataaatgatactaaatatgttaaaaaagaaacattccagccaaacattagaagttgaccagcaatataagtacaaatcagactacctaatcctccaacactcccttgaagtcctatcatttgacttcttgttttcccatcaaagaaataaataatcattattaataacgttgaggagataagtccaactccaaatccaaaaagtagtcttgtaaccatcataataattatatcttgaaagatatatggtgctacaccgcctaatccacacaatagcagtcctattagaactgttcttttatttcctataacaccagagattaaactactacacaggattgctatcatcattgacaatgacggtatggttgttattagttcaataatatgtactggaacatcggaaaacgattctgcaatagcaggtatattcccggctattgcatttatggatgctgtaacaacagcacagcttaataaagcaattttcaataatatatttttattttgattcatctttccctttctcctttcatttcatgtttatcataacatataaaaactgtatttataatgatttaaaataatcaatattattgattatttttaattttataatataatttatataggtgattgtgatgaatattatagaggaattatatttttttaataaagatgaattgttttttaaaaaatattattttttggataagactaaacaaaatattgaatatttttataaagaaaatcaaaatgatgctacaaatcttaatattgcactacatcccgaatctctaccaatctatcattatgaagatgattttataaaaaaaaatcataatatttctattataaaacaccctcgttatattccttactttgagcataaacatgcttatttcgaaattttatatgttctagatggacaatgtgataatactatttttgatactgaactattattaaaaaagggtgatttttgccttatagcccctcatatttcacacggtgttaaaaattttgatgataattctatagttatcaatattttagttagagaaagtactttcctagatacatttatgaactacatcaaggataaagatttattaagtatattttttataaatcatcttttttctaaaactaaaacgaaatatcttatttttcatactcatggtgactctcaaatattaaattatgtattacaaatgtatgaagaacataaacagatggatatctattctgatcgtattatttgcagtatgttttctatattaatgtcattacttaataggaactataataaagacattacaatttctcaaaataatataatcaaaaatcttcctgattttcagattattgattacctacttaaaaattataaacatgcttctttagaaaatattagcaaagaattccattataccgttccttattgttctaaacttatcaaagagacgacaggatattcattttcagagttactaacaaaaattcgtatgcaaaatggtaaaaatcttttacttaacacaagactttctattgaagctatcagtcttaatctaggatataagaatccagaaacttttattcgtgttttcaaaaaaaattatcttataacaccacatcaatttagaaaacaagctaacttataaaatactttcacttgattcatggtgtattttacggcacgaccaattgttatttttgtatcatttatttttactcttcgatttattacagtttcaaataatttatcaatataataatgatattttttcattttcaaacctggtatattgtaaatgactcatctatatcgtcatttacaatatacatatcctctctatcaaccttatataaccgtggttgattacggttttattcatttgtaaaattgaatttgtgaatatggatttgtatttcattcctgtgactttgactacttagaggaggttcttaccacaccttattccaaaaacaatgattagtaagatgagtctttgaattcgtattttgaaccaggttttgtggtctaagtgttgtggataaccattttcacatatttcaacaaagaaaattatatctttaatctaaatcttctccatttgatgctataacttttttataccaataaaaagaatcctttttatatcttttaaaagttccttctccttggtcatttgcatcaacataaataaagccatatctctttttcatttgacctgttgatgcagatactaaatctatacacccccaagaagtatatcccataacctctacaccatctaaaactatagcatctttaagattgtgcaaatgttctttaatatatctgatatgatattcatcatgaatctcaccattttctaattcatctataccaccaacaccattttcagcgataaacaacggcttttgataacgatcataaaaagcgttcaaagtcgctcttaatcctaacccatcggtttgccatttccacgcactttccttttctttaagataaggattccttaaggttggaaacatatttccctcacccttttctgcatatgcattaggatcagcacaagttaaatgtgaagaatagtatgaaaatgaaataaaatctactgtattttcacgtaatatttttttatcatcatttttaaatggaatgattatcttcttatgttctaactcctttaatttatatactggataatatccacgagctaaaacatcagcaaaaaaataattatttctatccacttcatatgcttgccaaatatcttgaggcgcacatgtatatggataagttattcctcccgcaagcatacaacctattttattttttggattaatctcatgagctattttagttgcccatgcacttgctatcatttcatgatgtgcagctatataaatttgttgtaatttttcttcttcacttctaacaactactccagctgcaaaataaggtagagctgttatacaattaatttcattaaaggttaaccaatatttaacaagatctttatatctcattaaaattgttcttacatattttttaaaaaattcaattgtttttctgctttcccatccttgatattccttaaccaagtgtaatgggatatcataatgagtcattgtaactagtggttcgattccatacttatgacattctttaaaaacatcttcatagaattgtaacccttcttcattaggttcttcttcatcaccatttggaaaaatacgcgaccaagaaatagacattcttaatactttaaaacccatttctccaaataatgctatatcttctttataatgatgataaaaatcaatacctgttcttgaaggataatatgtatcatttttatcattaaaattatctaaatttcccatcattacagaaaaacgattacacccttgaggaacaaggtcaacatgtcccattcctcttccgccaatattccaagctccttcacattgattggcagcaattgctcccccccataggaaatctttcggaaagttatctccatttgattttttgtttatcattttattcacctaccggttccatattttgagcattttctttttcttgagttaacaactgattatcatatactttaaagaaaggataccaaataaaaatagttactattaatgctacgatttcaaacacaatcatacgccagtctagacatttaataaaactattaataatgattgggaatgttccagtaaccaaaatgtaaaatggagttattaatccaaaagcacatgctaaccaataaaaaattgcaattacagttccactcaatacaaatggtatcattaaaattggattaaacataataggtgcaccaaatataactggttcagagattctaaaaattgctggtacgattgatgctttaccaaaaacacttaattgtttggattttgcttttttaaggcataggataacaagagctaaagtatttcctgttccacctaataatgcaattgcttgtgtcataaaaattggatggaagataggtgcttgtccagcagcaaataattctgcattagcagcgaacgctgccattgtaattggcgttgttaatggcataaataccatcatcccatgaacaccacagcaccacattacaaggataagtacagatacaagaattgctcctggtatagagtttacagctgatactggttttgctaaaattgtttcaattaaagatggtaaagaactacctggaataaaattactaattaataaatttactgaaaagaataaagtcacattaattaccaaaggtacaattgaagaaaacatgtctgacaaaaatggtggaacaccttctggcattttaattgttattttcttttgcatacaaattcttgtaatttcaacagtaagtaaacttacaataattgaagtaaataacccttgtgaaccaagataagtagtattaatcattgaagccacatttccatcagccaaagctacataatttgctggtgcagcaacaatcataaagataatcattgatgtaaatcctgcattcatttgagataatttataacttccagctaaataataagcaatagcaaatgccgaaattaatgaaagcattcccattgtcatgttaaatggtattaaaattgttgctttatatgtttgtgaaaaattgtaccaaccttcaaaaattgaccagaaaccaccttgagcaattaagtcagctgtcacaggtggattagcaataatcataaaaattgctgatactaaaataaagctgactgttgccataaaccctttttgcatcgctgaaaagtgcctttgagcaccaaagaaattagcaataggtgtaagcttttcttgaataaatgtcataaaactattcatgagttattcctcctttcccaaacaagccttaacctgtttcataatattttccacattactcatcccataatccattggggaaattttttctacaggcacatcaattgcattagctttaatttcgttatattgataagaaatttgtggaccaataagaatacagtcaaaatttttatatacatttaaatattcactcattggaacagctctaacttctaattcaatatttttttctttgccccatttttgcattttgttcattagaatacttgtagatagaccatttgcacatattaatagtattttcataactattctccctcatatttttctttacgcatttcaatcatttctttaattaaatcaattgctaacatgcaagtcattaagtgatcttgtgaatgaatcaataacacactaatatctgttttttcaccattagcttcagcaaccaataaatccatctgacctttatgagccaagttcacttccttttggctttgttcaattaaatcgtcagctttattaaagcaaccttgtttagctttacttaatgcttcgaaagctaatgatttcgcttcccctgcatgagcaataattgtaaaagcgatttgttctacatccattgtttcacctcatttttttaaaatcattaaacaaactcttataattgatcgatctttatattttccttgttcaacgatatcaatatacaatgaattataagcttcttcaaatcctttaaaatgtggatatttctttctttttatacactaattttttaatttatacacttttattcttttttgatttatttatgtagtatattgaaaaaatatgaaacaatacgcaatttttatcttcacgttttttacaataatatgatgaaaaaatatacactttatacactaaaaaaataaaatctaacttttaaagctagatttctttaatcagtttaataagaattgctatatctgagtcagataatgtaatttcataaacattctcaatattcgaaaatatatcacaaagataattatatattctcttatttgctagtattattttgttataatcatcaatttgtttaattttttgttgatgtactagttgatatataagattacttatatgcataattaatcctatcttttgattctgattcaaaggatattttatatcaattttgttaattgtattaagtaatatgtcctttaataagtcgatatcaaaatctggcatttgttcttcaatatttttaaaaatcaatgaatattttacccttttttttgtttggaggtatttgccattcacactaaataattccgataacttctcaacaggtacattaaataatttagaaactgaaacaaatgaaattccgtgtaaatgagggtcaaacgttcctacaacatacagtatattatatttgtcttttaaatgattgatttgtataataagctgatttttgctccccatagataaaggaacaatatcaatattttggaattcaatattcttttctaaatatttttttatttgcaaagctcccccttcaccactcatgcataatgtgataataatattttttttaagttctcttttataattatttacaatagatgggaaatatttttcataacaatcattcatatttgtcataattaaatccaaatcataaattgtttctatttttctagcacattctaatgcaactaaggtcgttggagatattataaagtgaatgttaataccggtttcatctgcaatttcttcagccatggtctttaatgaacccatatcatacatcattagtataccttttcccatatcaatttcttttatcagggattttaattcattatatgcatccattgcttctttatctaatggtaaattataagcatagactttatttgtccttactaaggattttacaacctctacaagagaagaagccgtttgattaccgtgcatagcaattaaaaaaactggaaatccatcatcttgcataattggatttttttgacaaataaacatagttattaaagaagcttcttctaactcaatatgtatatttaattgttcttctatcgtatctaagagttgtaaactcaatacatattctttatgattttcatttatcatttttttaatattattatcattataatttcttacttttggatgatctataagagattgtatatgcaaacacaaaccataaaaaattgaatcagaaaaaacacgattcaatttataggaagcattatttaaaaatttttttacaatctgaataatttgataatttactattttacttagtgacgtttcatctatattttgatcctctatttgttttgtatatttctttaatgttatatttatatttgaatcttggaacaagctttcattataagtgttatctttcaaataactgtatgtagccaaatgtttttctaataaagaatcatcttttattttttcaacaaattcttttgaaaacctatataaacaattatgagaaataaattttaattccggtacatgatttttataaaaaattaatccttttttcacatatttaggcaaatcatctaaatatatatgaatgtctaaattattgtatttcatttctcttaaatgggcactcgcacatccgctttttatatcagttattaattgtttaatatttttttcacaatgatataataataaacattgtaatacttcaaaatcaacaataaaatttttgtctattttttttgcttcattttttaaagtatcttttataatttcaaatctttcatctaaacttctttcctctaaatccggaaaatcaataattacaggcatactatcaaaatagttcttttcaaattctgcatctacattttttcccgaagaaaaaattaaaataaaattttcttttgattgtaaagttataaaatcatatataattgaacgtttatcttgtgatattaaatgtatattatcgacaaataacatcccattcttaagttgttttaaaaattcattatcttttaaaatatttatcaaatcattttcgtgattcataaaatatttacaattaattttagataatttgatatcgctagaaattcttttagtttctttaagatgatgaaataatgtttgaacaaaaaaactttttccaacaccactattcccaatgagaaggaacgtataatttttattagggtacattaattctgaatgaactattttaatagcattttttaaactaccattataccctatcattctttgaaatatcatattatattcttcttctatttgattaagagtgataaacctatataaaactggtctaccatctattttttctaatttattatctttaactaattgattaagtattgatgataaatttgttctttgcatatgaaaatgttcaaccaattcttgagttgtaaatagcttatcttcattatccatacttaccattctttgtatatatgataaaaccaaatccttttttttcatatgtattcgcccttcattcatcaaaatttaaaaacaatatgttttttttattaaactttggcattgtcatataaaaattaatcttattataaattaatttttatatactccatcattcctacgcctataatcattataattaatcaatataaattattcaatataatagaaaacaagtaaaaaaaacagttgcctaaacagacttcttataaatctatttagacaaccacattttaaaagttattaaattttctaaatattaacatatccttttttatataactatttaccagaaacacatccactatccacaggtataacaacaccatttataaatgatgttgcatcttcacacaagaacataacttttatcaagaactctcatacattcatcaaaaccttttttatatctattgtccatgaatcatttaaatttatcctggggatcaataataattttcccattttccttagcacacttttcaaaatcagctctaacaattattatttttttcaccatatccttcagaaacaggcgctatattttttttgttatctaaatcatcatgaatcttatcattattctcactcatggttctcatctcctttttgtaccattaactgatacagccgtaattgtacaaatgacactttacaattgtatcattatagacgtttcttaacgaaggagtatttatatattcttcataacttattgcctttattgtattgctcatttttactgtatcccttaactaattttaagactaattcttcccatacaagtgcttctgtattgtttaagcacgatagaacttctaacccagctactaagcctctattagctaattcatttataatttcacttataagcaattagctgtttcttgcgcttctgtatgcttttttaagagtgatgctaattctttattttctatctacatcactcaacttcatttttaataaactcaacacctaaattattcaatacttgttttatgccatttaaaacatgtaacaaacgctcttctattgttaatttactcatctttcttttttatcctctattaaaatagatttcttatattgctgcactctttaatcataacaatcatttcatttgctttttcttctattgtgttacaaaatccatcaactgctttttctttatctatgtcagcttggaatatatattcttcgctacctgtacaataaggcatcaaataattaattgtacatacattatgagatactgtgatatttgtaatttattattggagttaaacctggtaaaagtgattatccacaaaacagtaatactatttcaccagataaaaagttagagaagtattggaaaaaagtattcaaaccattgaaaaatgaagaaatagaaaatatatacatcatcattttttccaaaaacaactttattttttaaattactaagatgcttttctgcaccttttagagttttaaaaacttttggtttttgcatattaaaatagctacttggataaagatatgtgccgtccatatcactatatgttcctgcataaattccatcgttatatttgattacatacatttttcattacctccttttaatccaagctatcttctaaaatactttttaagattgaacgtacataatcatatgaacgctctcgttctttctgctcttcttttgtatatctatcataagaatatccacgggtattagtttttccataccctcggaaaaacaatttctcattatttttgcatttaaaatacacatatctaaattcaaaattgaaattcttatatataacataaatactatttacatcattgctgcgtatacttatttcaatttctggattaattttattaatttcttcttgaatacattcttttattaacaaagcatatttcttttcataattttccagttcttctttaaatttcttaattttattcatttcaatttctctttttattcagcctcatcatagagttcactaacatgataaacaactatagcatcattaaatgctttatttattttatcgctgtttttttccagccagtcttgtcgtttttcttcattctatttaatccacgattttggtacttcatacagtattgaaagttgtattcatctttcaatttagcaaactttaaatattcatactcaaatcgggtaagtttaattgtttctatttttaacattttttaccactccttataaatgccaggattcctgcaaatgcttcatttctccatttttctattctttcatttacagttttttcaaaataattaatattcccctcataatcatcataatttttatttaacggtgataattttaatctgaatttatttttaaaattgatatcaccattatcaagaatattcgaaatactatatatcagtgaatttagttttttattgtataaatcataatcatcactccagaaaactgcatcctgcagtaagataattcttaaatttattcggttgatcactgcgttatatagatttatttgctgtaaccgttcatcgctatatccaaatttgcgcctacagtatttaaattttttatatgtcttgcctagtgagataataattttagataatgcaacgatgtaaaatttttcaagttttgcaataaagttattaaaatttcttttcttaatacttttgtctctatgatccttgtaccaaagatgcctaatttttgttggagtcacatcgtacttttctactatgacattcccgtctttatctttcataatttcattttttttgcatatcattaccatattaggatcatcttttttgcatgtccttcctgtaaatttatttatgtacatatttcttttgtatttttttggattagatataggttttgtaaatacttttctttcaaacacaagaaaatctatgtatgtcccgtttccaacatttgtaaatttataaacaaagggaatagatttataatctagacttatattaaacataaactgtttcgcaagttcaaaagcgaactactatataatacatatacaaatacatagatttcactttctctagcaaaaacaaaaaaggaatagccgagttcataattcagctactcctagttattttatttgtttgaattctaatatataactaaagaaaatattctatttaactgctctttttttacttaatcccagaaaaccaagaactgatattgtcgaaacacctaagacaatatagccaattatatttttattatctcctgttttcacagacttgttattagaatctgtaaggttttgagaagtatcagtagggtttgatgtttcaggagttgatggttcaaccattggtggaatatcttctttaataacttctatatcataagtgtattctacttcattaaaagttattgttacagtctgttttccaaccttttctttatcataaccgcttaccattgaacttttcaattcaatttctttaacagcaccatcatcatatgttaataataatttaccacctgtaagatctaattcctcacctaatttatactctttttttgtcggttcgataaactctatattttctaattttgctggatttttaaccaaagtaatatcatctgcacgtaaccaatcacctatactgattttctcgtattccggacaaataaaatgataaggcttgctgttgatattgatttttctagaaacacctctagcgagccttacaacagctatctgaagctcagttgtttcaatattaattctaataccatttctttcaccttattattagtatatcagcttataaaatcaaaaaacacgacaaaaaaatactatatccatttcaattcatatataatttctatatatgttttcatgtgttttttcatgttatttcatattcaaaaatacgtgaatctcttatttttatacatatttatttcattttgtatgccaaaatgtatgccaccctattgtcgggtataattgacttttttcgtatagtaatgaccatattgtgttccatctgttccaattaaatattcctcttcgcttttaaaatctaaatcctcaatagctttagatctttcatttgcaaatacaggaattttgattgttacaaaatcactatgacaaattgtataaatatgaggtattatgagttgaagaatatttttgatatatttgcttttttcgtaatcacttcttaaatccaaacgcataatagctttaccattataataatcctcggaacgtctttgaaataattctattgttccaatggctacatttatttttttatcaataatacataatcttataaaatgcttatttttgctattttctaaccaaaaagaaatagcttctttcattctttgtactgtttcatagtgaaaatcatcaccatgacaattatcgctgttaaataattgtagagcctttaaatctgaataaacttctaataaatcttttgcatctttgaactctactattcttaaacgaaatggattgttttctatacatatattgttatttacataaatcatttttctgcctccattattatatataaaataataacacagtaactatgacaactatatgtcgcaattactgtgtaaaaattcccatgctcttttatttaattctttcttgacttccaaaggttttaaaataactatttcattaccaaaagataatagtgttcctttccataattcttcatctttaggaagatgtaaagataaaacataatcaccattatctttgattgaaattaattttgcattgagatattcaactgctttaatacgactatttttcttacataatatttctatatcacaatattctctttgatcattcatttcatttttcataatttgataaatatcttgatgataatgattgttaaagcctgaagtttttttgatattttccattcttataattttataatatctataatcttttttatctctatcaaaaccaacaagataccatgaataccatttataaataatcgcaataggatcaactttcttttgtgaaaattcattttttgaatttgtataatcaaactcaacaacactttgattcaatattaacctttccaataataacaaattcttattaattgattttttttctttaagaacactaaaatctagtatgatatgttcttgtgaaacatgatttaacaacttgactttatttaaggtcttttctatttttttattttcaaatgcagtattaaaaccttttaaagctgataatattatttcataatcttgatcatcagcaagttgtatatgcattttatattgttcatcaatttcatatccaccgtctattccaacaaacgaaataataggaaatcctgcaagaattaatgtatcaatatctctttgaattgtgcgaactgaaacatcaaattgatttgataatgttttagcattaactcttttatgattaagcaagtatattataattaataacaatctttctattttcatttctctctaaaatcccctctattgacttgttaaaatttaaaataaataagatatgaatttcttgtcaatttatgtatattaatatcttttactatgatataattccaattagaactatcaataaatggtaggcggttgttccatttcttagtcttttgaagaaatggcagcgtcttcaaacagtaatctctttttgagaaataaaaagctgctggagatgcttatggtaacatatgagagtttattccaatttgttataatgcttattgcattaatctctttaattatgaaaattcccaaaagaaaataaccgcccttcattccactgaaacggttattttcatataatttttcattggaacaaccgcttatcgatagttccttttcacttatattatactcaaatataaaatttttacaacttttattacatacttaattaaccattctcttaaaatagtaaaattgattatcaaatttacttatgctaaaagattttatataaagtattatactcctgaatcattcaaaataaaacacagtgttcattcccatgacgctgtgttttttattgtaacttgtatggcattaattatatttccgattttcttcaacaatgaccaatcacttatgctttttcaggtcaatcttttattttttcttaatgtgtctgcattcaggataattcgagcaagcttcaaatttgccatattttcctgttttatataccaatctactgccacattcaggacaaacttctcctgtatattctaattctgtttctttcttcatatcatccaccgtaatatcctccgcaataatatcatttatttcatcatagacggctgcacagcattgcttaactgtaagttcttttcgatatacacttttaattaaagtatttaaataaacgctcttttctgtcgttatgtctattttcagccttctaagtacctttacatattcttttcctttgtctgtaatcttgtaaacagaaccattcaaagcaattaaaccatattttactgttctttctataatatcaggtctagtagcttctgttcctatttctactccggcatgaattgacctgtacaactcatcatcattttcctgtatatcaggtagttctttttccctttttaataaaaaaagagacatatctaaattttactcgctttcttttttttgatttattgaattgttttctattattttgtctctattctcactgtagtaatttttaaaatatttctttttcttatctttaatagccacttctatgcactctgccgaacagtatacaagatggcttttatttatctcgaactttttaccgcatacaggacatttcttatgctctctttttaatttattctgtctaatcaactaattttttctaaacgttctttatttcttatttcgtaacacatatccgaacaggttattattccatttttagaattaaattttatcacaaacaacacattttttatcatataggtatttctcccttttggctgtatcactttcattttattataaacactttgtataacatcgtcgactgtttataacaaattaatgtgaattagttatgcacatatctcactctttatgtcccttcctttttcccttgtataagtaaatataattattactaaattatattttattagtctttagtagtcaaatatgatgatatctaaatagttcactattataaacctcacgaaaaaaagatacccatgcgtatcctttttacatgatattactaataatattataaagggaaagggctaataagcctgccattaatccattaaaaaattgggtaattcgtgattctgacattttttgattaataatcgttcccatcattccaccaactattgctgctacgcatatataaggtactaaacttaaatcataggtaaataattccttagtaattaataacgttgctattttggatatttgggagaaaaagattgtagcaattgaataaatagttgcttctttgattgtaaacgagaataaaatcattaataaaactacgtttaatggcccaccgccaatccctaaaaagatggaaatactacctaaaaataatcctactgcaaagatagcgatgatattttttaaatgataatgtttgattttatttttattaattgtatatcctaaaatcgcaactaaacagattgcaagtaaggtcgcctggataattttaacagtactattgctaaaattatctgcaataacactaaagattttctcaccagctaaaccaccgcataatgatcctagtgatattgatataaccatctttaaatcaaaactaaacccattttttaattgtttcccgattgaaacaatacacattgtaaatactgccagggttgaataaactccaaccgtactggcatcatgaaccccaagcgcatcaaataatggtttgataataacgccgcctcctaaaccacctaacgctccagcagtagtagcgattaggataattagagtatatagcaaagtaatcattagcgtttatcccgacgattcggtacaatatctccagttgcttgatagaatgttaacatcaagtctttcatcttgatgacttcattataataaccgggatcttcgataatattatttaattcttgaggatcattatcaagatcatataattcatcttgttcatataatcgtttaacatattttaaattcttcattcgaatcatcgttgcttttgtatgctcaggcccttcgctagattgtgtatctagacgtggccaatatgttgattcgggaccatgaccactttccatcgcccaagtttcaccatgaattcgacccccttcacaaaatactgcttccttatggaactcattacctgctaaagtatctagtaaagatttaccaaactgaatgtattcagtttgaatccctgtcatgtcacagactgtttgcgttaaatcaactaattcaactaaagcattagaaattcgtggttcacaagcaaattgattagctggtttgactaataacggcacgttagcaattggatcttcaaagcaattttgaaccttttcactaatatcataatcaccagtataatcaccgtgatcagagaacacaaagatactagtgttatcataataatttaattctattaatttatcacgaagcattccgtattgataatcaaatcgtgataccatcgctaaataagttgcccgcatttcaataaaattatctttaccccagtcacttaaattttgttttctggcgatttcttttaccattgacggttttcctggtaaggtcatagcactaggtcgtggtttagtcactaaactccggtcaatacttgaataccatggatcttcacatgcatatggtggatgcgggtatgaaatagtaatatataagaaaaatggtcgtggatcatcacgttcttggagatactttaacgcactctcaactgcaatccagtcattcatcatatgaccaccagtatgtgcctgttcttcggttattattccaatatgctgtgaataataaccaggtacactagtatcaactgcctctttatcaacatgataactaagtccatcttgatcgatatattcaactctattttcataaacacgtccatcaaagtaaacatcacaataatcacttttgctacaatcacttgggataatatcatttcgtcccacccaaataacttcataaccattattcttcatagttcttaaaaagttcggttcatcgggatcttgaagataatgcatagttcgatgaccggtagtatgcggatataatccggttaaaaaactgcaacgtgaaggtacacagacgggattttgacaataagcatttttaaaagaaaccccttcttctaaaagtgcatccagattcggcgtaattgacgccttacatcccatatgatgtaaagcatcattacgcatctgatctgcgacaaaataaacaatatttggtttattattcattacaattacctcccatattatgcacttaagttttcttcctcttttaatgcctgagcatcagaaattttaaagaatggtaaccagattaatatttgtacgccaattaatactacttgtaagattgccccttgccaacctacacataaaaatcctagtaatactgctggtgttcctaatgctggctgtaccccattagcatatggtactaatccgctaagcatcgcaacataagaaattccaaatgtaacaattggtgtaataattaatggaattaaagtagttgtgtttagtaccattgggaaaccaaaagtaattggttcgttaatcccacaaatacttggtgcaattgctaatttacctaaagatttatatctttcacttttagcaaagaatgtcattaaaatacatagacctaaggtaccaccaactccacctaatgaagcaaagttcatccatgaagcttgagtaatgatattaggtaatgctgtaccgttttgaaatgctgctaagttctccattaacgctggtaaatataacatatttaaaatcggcattacaatatttccaccatgtaatccaaagaaccacaataatgaacaaagcataattaataacataaatgtaaatgggctagcccctaaactaactaacggtgtttgaatcaaactataaatacaagtattaaaatcaccgtatgaagttaatgaaaacccccagcgaataatactaaataataatacgattgaaattcctggtaaaattgccccaaaactttttgaaatagttggtggaactgattccggtaattttatagtgatattgtatttcacaaagataaagtatagctttgaagctattaaaccaataatcattgctgagaataaccctctagctcctaagtaagttgttgctaaaaatgttccagttgttccatttacttcaactgaagtaaggggaatcattaataaaaagcatactaaggcaactgaacctgctaataaactttctttttcataaccttctttttccccaaaagcttttgcgattaaaaagacagtgtaaatcgataacatatcagtcgttaccgtagaagcaaatgaaacaattggtttaattccggtactagtaataaagtcttggtaaaatccaaggtttaatgatgatgctaaagtaaatagtgctcctaccataattacaggtaatgcataggcaaatccggtacttacagaactaagatatttgttgttagccattttattagctactggtacaagaaaacgatctaaaaaacctgttaaagtgttcataatatatttcctctcatttttgttttttaatttcgtaagcgctttacagatgtattttaacactttttgaaatatatttcaatattttaataaaatatattttattcatttcatacttgtttgaaatttatttcaaaacatgctataataaaataaaggagaggattttatggacatattagaacaaattcagagtttatttgatacttataccaataatgaaaagaaaatcgcccaattcatcattaaagatccaaaatattttgcccgggcggatatcgaaaaattgattgaaacaatcggtatttctaaagcagcactaattcgtttctctaaaaaagttggctttaacggttatattgaactgaaatacgaactaaaccgctatttattatctaataatattaaatccgaccctaacgaaattaatagtgccatcaatcatattacctgccgctatattgaagccatcgaaaatatggctactgatctaaatagtgaggatattaatgccattgcaaaaacattaatagctagtaatcatattaaagtatgtggttttaataaaactggcgctagtgctctccacttttgtaaacgagtattaaattccggattaagtgttactccatgtattgatgatagtgtccaaatgattgattatatcgataccctaacgtctaatgatgccttagttgtctttacaattgaagatacgactaaattttttagtaaacatctttccagtattaaaaatactaactgtaaactaattgtatttacttttgataaaacaacgacgattgccaaaaatgctgattatctatttgttttacctaaaatatctagtcgttatgctacatttttggatttacaggctttattcttcattgctattgaaatatttgttgctcacttagctaaattacaaaaataaaaattaccctttattttaaaaagggtaatttttttatttaatctgattagctaactggtaaaaacgctgatatgttttcgttaaaaaagcttgataaccgcaatacttatcatcaaagtaaacaacattcatccgtttacaattaccattacatagctttttaaacttacaatcatggcataacggtgacatccgtttaggctcttgaataaatttttgaccattacgacttgattgaatactagatagctcatcttcattgatattacctaatagatattcatctagacagtaaaaatcacaaggataaacattaccattagcttcgattacatattgtaaagtacaaaaacccagcatcccgcacatcgatggagctacgcctttaaataatgttaataaatgatcaaatagggagatggaaatatactcacccctagttacatcacgataccataaatcaaataactcattataaaaccgaaaaaacatctgtgatgttaaataataattatcagtactttgatctaattccggtaaacagggaatcagttgaatatactgtaactcattttttttatagaaattatatagtcgtttagcatcttttgcggcctgtcgcgttatgacagttaaaatattatagtttatctgagcttgtttaattttcttgatatttttcatgattaaatcatatgttggcaaagattggttggttaaacgaacctgatcatgattcgctttagtgccatctaaagatattccgactagaaaatgattagctttaaaaaatgtcagccatgaatcatcaagattaattccattagtttgaattgaataatgaataatttgattatgctttttttcgttaaccttgtttacaaatattttaaagaaatctaagcctgccattgtaggctcgccaccttgaaatgaatatgtaattttattactcatcaacaaagtcttagtaaccaggttatcaatcgttgcttcttgcataatcccatagctatagtcactacgctgactagccacattagcataaaaacagtatttacaagccatgttacataatgaagatgctggtttaattaaatatgataaatgcataataatcacctcgtttatattctagcgtattttaaaaaacatttcattataaaataaaatattttttaaaaataaaactgatataaaataagttgggatttgagctatcaataaaatattgatttggaaggtatattataattatgagtggcattgtaacagcaataataacagtagtttgcacatttatatttcaaaaaattattattatgtttccagtaaataaagatattcttgtattaaggtttgagttatactctgatcttgattttaattgccaaagactatattcaaaaaagatttcatgtattatttatttttttattcatcacttcataaaaaactactaacagcatatggcaaacatatgattaataaattttaaataactactatgtgtattatatcctgcatctgtaatcttctgtcactattaaatatacaacacaaggaaagtgtttatcatcataaaatatctccgtttctcattgtaacatttcaaaggagaattaactatcaaataaaaagcaacagtctacaagcacacaataaaaaacaaaagcaaattttagctaactcaaagcaccgttagacaaaatagaacaaaacagttttataaaattaaatatttaacattgtttccaacaaagaaagtccagaaggaaaaaaagctctttatttcagcattttttctggataacttaacaaaaaaaatacatatatgatataattaatatgaataataagtggaaatatttataacatataaaatttatttttgggagggaattttatgaaaaaaaaaaataacaattattattttcactatttatttagcatttatcttcctatatccgttgttgagaggttcaatcgcacatattaacggttacccatcgtattttgaaaaaatacttaagtgtataaacataattccattctattttgattacactgtaatgccgtctgttattataaaaaatattatttttaagatttgtctatttattccagttggttatatgcttttcacaaaaaaacaaaatcaaattcaaactgtgaaaatattattattaataggatttttaaaagagacattccacttattaattttatacggttattttgatataacggatattttatattatctagttggaggattaataggatattatatacataaaataatattcaattttcttttgaataaatagcaagaaaacgttttcgatttatttgttgatactttttataatttaaaaaactttgaaatggagaacaaaaaaatgaagaaaatcattgcttttttactggtgtttacattaagttttggtgcagtaacaaatattagtgcgttaaacaatagtgcagtatattcatactcttataaagactatgaaaccacaattcttaactctaccaatgaatataatatctgttttgaaatagtagagaatggtgaaaaaataaaattagagtatgatacagactttagatatgtgaaagttaataataattattacgattttaatgattttaataatgcggtattattacaatccacatatatatacgacaaaaatcaacctattacaattgttgaagcgttaaccaatttttcaaagattgatattgataatataaatgatttaaaaagcaacaagatttcagtaaaaaacaataactcgttagcaccaaaagcagagtacggtaagttttattttgttggaagtaggaagaagagtatgctggtatctttagcaagtagtgcaatatctacaataattgcattcttagtaactggtgccttaggacttagtgtgacaaaggcaaatgttgtttcattcatatcaggagtattatcctctgaaggggttaattattttacttctgatgtatattataaggtttatcaagctattttaaatgctcataatacaacaagagaaaaaagaattttaggtgtcttccaaccttttaaagcgcaagttgtatgggatgaagcacacccttattacagaacgtttgaaacacagagaccaaacagttaaacataatatttcaacattgtgaaaggaaatacaaaaatgaagtgtccatattgtggaaaagaaatggataaaggattttttaattcagcaaaatgggattatacatggactccggaaggcaaaaaaccccatatgtggagaaatcacccaaaagaatatgaagttcttttaaaaaaaggatggaatatactacaattaacagcatatagatgtgcggattgtagagttataattataaatgaagatgattgttagtataaattccattatgctaaaatcgaatcgttgatgttctaccttatcgtttcgttgcagaataaaaaaattactattaataaatacaaaaaagaccgtaaaatacattacggtcttttttgtacccaatttccttcagtcgaaccgctgaaccgttagaaattatgaaaatgttcagttacctgtaataaaacaaaattattatttttaatataaagtaacaaattagaaacactaataaacatttttcctctaatggcgactgacaaaaatcaagcaaaaaccagagcaaaaacaatatcattaaaaatactaaaacaataacggtgaaatacacattcaagctaataccgattatagtcaatagactaaaaaatacagctattagacttaaatgtataaaatgtttttttgtaatatcatccataatcatatcctcattctattggttttatatcatcagaattatattgcactataaatttgataataaaaataattaaaagaattaaacagcatataattcccgcaaaaaaaatatagtgaccgcatttaaaaacattagttactgttagctttttattcttaacaaatagtttcgttatttcaaaaatccaaatagttataattaattttaattgtctgtcattgagaaaactatctgtatcgttccacatatctttaacaatattaataccaacactaaaaatacaccagccaatatataacagacatataaaatccagtaattcatataaagagtaattataaatatttattgatgcttctaaattcatccatcctgcaatagcaaacataccaattacaatacaaaatgactgtaacagcacaaatctaatataactcaagaacagtttccaatatcttaagatacatatcgataatgattcttctcttataaaagtcacttgtgatccaattggtggttttatattgctataacattttaaataatttattgattcatattttacattttttgaacttcattaattgtatttcctcccacagtcaagtataatttctttcttcaaacagttcataagcaactttttgaaaaagctttataatcataagtacggtaagaatttttaattttattgattacatcattaagttctacttcaaattcattaccagatctgtttaaaaaataaactaaatcaatccaccagacaggttttcccaatggtttccagcagcctttagattcattcatatctggtaatctaaaatctttcaggtatttgagataattcttaattattgtaatcgtcttttcgtggctgtttaccacaccttcaagttctattattagattttttgttttataataaataaaagatagattatccaaaatactttttacctgctgtttggccaattcacacctgtactgatctatatagctattaatatcctctaacagttctttttcctttatcatttaaatttatcccccatttcataaacaagatcaagtctagtcctcttttttatcattaggattttgatctttccattcatctggaaatgcaatttgttgtagttcatcagcacgatcaacttcttcctgtgttaatttctcatcattttcaatgcctgcatctctaaataatgtttttactgtatgtaaagcatacagtaatcttccttttttacttaacattggtcttctccttatttcatttttatttcttcttttaatttatcaaacctatttctctttaaaatagatttcttatattgctgcactctataatcataacaatcatttcatttgctttttcttctactgtgttacaaagtccatcgattacttcttctttatctatgtcagcttggaatatatttttaccatgctctaagcttttttcttaaactttccattgctctataatattgttctctatcttcttcattttcaaaaatatcatcatcttcatatcgtatattttcattccataatagttccttcttgttttaataattttgcaataactttatctaattaaaatgacatagaatgtagttaatccatgtaaactattatttcatatggaaattcacattcattcccactttcgtcaacacgtttaattaatcttttttatttgttaacaattggtctttaagaccatttttcttcacttctttttctttaatatttctatcttcttttcttgcaaaatagtatatatttctcatttttttatctccaattttctattcaatatcatcataatatccatagctagcagaaacatacatagcatcattgaattctttgttaattttatcataatttttatctagccatttttgacgtctttcttcatcccatttaacccacgattttggtacatcatataaaatagaaagatctccattatcggcacagtaaattaaagctattaaaacatcgtatgaaggatgtaataagtcacaatgtatcgtaaaaaatgttgatttaattttttatcctgacacattcgttatctttaaaataattttatacaatgtattcaaattaacaaagagaagaaattcctcaccttaaattgaatgatattgaatactatctcttgtttataaaattatgaaagataaaggagatctaactatggaaaacaaagacacaaaaactgtttcagtcggacaagaattttacacagctcaagaagtcgctactatgctaggtgtatctaaaacaagtacatatagagtaatcaaacgcctaaatgcagagcttgaagaaaaagtatacattactatcacaggcaaaatttcaaagcgttacttccttgaaaaatcttatatttaaaccctaaattgaagtgtgaactgacaactcacacttctttttatttacttaaatattttaatcgacacattcgttttatagataaatatccgttatcatagtgatacaaaatatgaaacggaggaaaatcttatgaagtcaatttatgaaagaaccggcaaaggttacacacaacaaggcgattatttgttgccaaatcttcagttaaatggagaacctgaatacaatattggtatctgggggcaacattatcgtcagcatttaaagacacaacacaaggtgatctactacaattatttaaccaaaggtacattgtatcaacaccttgtagaagtatatgaacgtgctgaaagtatgtttaatcagcttgttaaatcacttgccacaaaagaaaaagttaccgaacaactaaaagaaaatgatatcctgctatgggttaaaaagatgaataacatccgtaacaaagctatggaaatcgtgaacagcgaggtgatttatgtatgagaaaacatttcattatcgcattgattttgctcttctctgtatcaatatcggcttgtaataaagctgaaataccagcagaaacaagtaatgttttacctacacaagaaacagaaatcattgaagaaacttcaacacaaatcactacatcagagccagcaataacagaacaattcactactcaagttgtagtcccaaaggaagaacaaagggaaaaaatcctaactactaaaacaactttacctcaaattacaaaagaaaaaccaacacgaaaacctaaaccaaccgaagataaaactactatcaaaaatatttctgaatctactaaaccagttgaagaaactacggttcagactacagaacaaaccattcaagagctgaaggtagacattgactattactttaattatgcaaaaaattatacattaaatatcggtttaacttatgatgttgaagcaacagaatgttgggataatcctatttctgtcacatcaaaaactacttcaactatcgcaaatatcgaaagcagattgaacaggtacaagaacatagaaggatttgaatctgtctgcatttggtatgaaaaatgtggcgaaaatgactacgatttatacataggttacgcataatacaaaaagataaggcacagtttatggacttcaaaatccattactgtgccttgtttaaagtataacatatgtagaacaagtttttatgtataatcttagcgagcagaccatttgggtagccacttgctatccaaacggtaaaactgcctcatctgaacatttcagcgagcagtgcatttgtgtactcatatccacaaatacctcgttagggaacaccctaagaccctgctatctaactaagacaatattttaatgcatttattttttctccatcaatatccaataaaattcttttaaataaattagattcttttacattatctaaaacaaagactacgctgtgttttgctctggtacaagcaacataaaatttagattttgtctgtttagatgatatattcttaccctcttttataaatggggttactgtcgatacaggaacaataacaactctttcaaaagtagctcctttagaattcccataattaaacacatcacaatgatgatgaaagctaatttttgatgctttgttatatcttaaaatagtaggttgatattttttacaatatagatctatacttttactatcaattatatatacacctgcattctctattgtcgtgtcaaccgaaaatggtataaccatactttctttgtctgaatgtatggtgtttataaaatcacatatttccttattgaatcttctagttacattagaatattcaacagtacacaatttatctttttgaagtttcaaaaaataatctttgatagcatcatctctatatttactatttttcctagaattgttagtcctaaaagtagcttgtttaaaatctcctacacacctaacattaattagagattcaaacataattttaattatttctaaatcccatcctgcataatcttgtatttcatctatgaatatataatcataaatattttctaatcgtttgattaccaactgatttgattcttctacacatttatgtgctaatgctgcaacattatctttatgtatgtctttagcagcatttaaataatattgtaaatgagtttgtttatatctagtattgatatttacatcttcataaaatgcaatagaatttataaaattaggaggaatattaatatttaattcttgtcttcctcttttacattttaatttcaatttagtttgatatggttttattaaatctgaaagaagaaaactataccatgtttttattataacgttcttatcaattattccaaaatttaatttacaatactcttcttcgatcgaatgtttgccctcattagtatatgtaataattaaaatgtcttttttagtagatttcgaaagttctatagctcttctacaaatatcatatgtttttccatttccagctgctgcaaaaaccacttcgtttttcactttaattatctcctatggctttttttatataatcaggataatttatttttacttcactttgaaaaatccttaatgcccattcgcttttattttttatcataaaatcacacaaatcactatattttacattagcaatattatttcctttatatacgatactacgaaacatgtcaaaattatcttcatttgcttttaatacagatggctcaagtgtattcaattcattatcatcttcaatacaaagcttaataattgatgaatactcttcatatttttgtttaaccttttgcccattaccgtcattatcagtaacgataataatttctttatttattaattgggctattttacaatatctttcaaatgcaattccacctactgataaaacatctataccatcatctattggaagtttttcatatttatcaatgtaagctttttgaataataagttcatctgctggtccttccactaaaataattttattagctaataataagcgtaatgtattataaccaggtaatttaacaaaataattataagtttctttatctaacgaggaaaaagaaacaacattattatttgcaactaaatgtaatttattcaaacctaatttatttgcaacaaaactactgtgagtcgatatgaataattgcttgtttttattattagataatttagagataagaatagacatatttgtaaaagataaattattttctggctcttctaatattagaaaatcaacatctatattttggttaaaaactagttctgatttcatcatattctgagttccaaaacctgaattttcaaatggtatattatctatagaaaggctcatttcgtttttccaattgtcaatttcaccttcttttagattaaaactaattgatctccctttaaaaactggttcatcctttatcttttcatttaacagcttaacaacttcactttctttgaaattctttctattacttctatacgctaatcttaaatttgtctcatcttcttctgataaataactagcaatactattagaaacaaatttatttaacaccgaaccataatctttcttagtagtatcgattatcgcaatttttttagatgtattgttaatgtaataatccccttgagcaaatgaactatactcaattttatataactctactggaatatctattatttttttatctcttaataattctttataagtatcgcaataatcattattaaaaataattctcattctaacaccaacacaatcctcttttaaagaattatttgttcctctatagtgtttaaatataatatcttcatcattcaatccatcaaaaaacacttctatttcaatcttaggcaagtttgctgatttacaatttacaacatcttctttatatttatttcttatatttatattgaaccaatccggtgtaactttagaatatacatttgttccattaatctttccggataagcacattgagatagcttctaagatagtcgtcttgccagaatcattttctcctgcaaaaatatttatatctggattcatattaattatagtattttcaaatattttataattacgtatcgatacttttgaaatgtacattctattccttctttcatatgtaaatcaaattatttattagtaattatctattttttattatccacataaagtaaaaatgttcttttagtaatcagtaacagtaacataactatcataaaacttgcagaaagaacaataatcgaaataatttctatcgctatttcattattaacctgtgttaatacaatagacagcacacctgcaatcaaagataatgtcgtagaagttattattgatacaaatgtttcctcagctacttttttctcaagttctttttcgctatcaattttcgatactaatattgctgcaaatccaaacaacactgtaaatataatagaaaatactgttgtaaataactctgctaaatcaacagaaattattaactttaatttaacaaccactacaactgctatcacaataggaaaaattacaaagcacacgaaatcccacagtgacaaattcttagttttagcatttctaaaaactttcatttgttcacagattatttttaataatcttacttttctatttccaaataacattatcaaaaaaagaacacctacaaaaatcacccaaaaattttgattattcattatcattctcctcggatttaatgctttcataatagttatctgttatttctgacaatgattttacaaaatcatttgaatcagcatatttttgatgaagttcttcggttatatcataatttcctaatattgaatcaaagtcattccattttaccttttaccttctttgccctacgcttattgctatttctgcatcgttataatcttctgaatcggagcattctaattttattcttgcaaatgcaacatctttgtcaatttgcccattgatcatttgtttaataatacccaaaacatttttgtttgctttagattcaagattcggtcctaaatctcgaacagctttttgtttctttcgtttattcatattttcagctatatcggatgaaatatcattttcaaaatattgtaaagtaagtttcttaggaacaacatcatccttcgtatccataagtggcaaatatagttccatttctaatttgatacctttacttttcaacatttaattagccgtttctaaaaatactgtcttacatccagaaccgttttgtctatgaaaaattatgacaaatgattcattacattcatacataaatattttatgttcataaagtgatgcactatctgcaccaaaatcatattttttccctgttgttgtttttatgattttaaagggctttccttgtttaccggcataaggttcaagcatccatctattggtctcattatatggcactctattatgtactttatcttctggcaaaaaaatagctcgttctgtacttttcccaacagctaaatccgaggtgaatttactataatcgtcaacgaagtttgaaaacgtataatctggtaattctccatctttgattttattttttagttcttcctttaatgggttgttgcgctgcaaataactaaaagcacacttgtacgctgtcaacgtttcaattttagacattttatatccccacttctttttacgtaaacttaacttcttaatataaaaatattaacaagtatatgatttttagtttagtattcatattgtttttctttttcaaaactatttatgtaaaaacttttccttaatttatataatattttatgctaccaatttacataacattatctgtccacaactcgcattgtgtcataacagtttgtactgcatcctccataccttctggcggatacttatgtttctttagtagctttttgattaacatacgcattttagctcttgctgattcacgcttttgccaatcaatcgttttattttttctaagtgtgtctgttaattctttggttatagctataagttcttcattttcgtaaaaatcttttattgcctgaggttttgttaatgcgtcatagaaagctaattcatctgcggttaatccaagctgttctccatccttgttggcttctgcaatctgctttgcaagtttcaacatctcttcaataacttcttcatttgtaagcattccattaagatatgcatttaatgatctttgcattaattcgctaaacttttcagatttaactacattagttcttttatatacagaaacttgttcagcaatcaactttttaagcaattcaaccgctaaatttttttctttcatattagctatttcatttaaaaatttcggatcgaataaagaaaattcttcttttacgtcagagaataaattgataactccatcgcttttgatgctttgctttaataactcatttatcctagcgttcatttcaggcaatgaaatctttttgcctacgcctgtattagttaatcttaaaaccagaactctcacagattcaaaaagtactgcttcaaatctatctacttcacaaacaagtgaagaacacaaagataacgcttgatgaagcattaaagcttctttaataaataaatctcttgtttctactttatctctatccataatgaagttaactgcaccacttatcgttcttgctctttcaagattgcttccagaaataaattgctcgtaattatatccgtggaacatatctttacatatagcaagcttttcaagaaattttggataagcaacttttgcaacgtcagtatctccgtaattctttttatcacgaatagtgtaatcgttcatcgcttgtttaagtgcagtagcaatacctacataatccacaacaagtccgccttccttatcttggaaaactctatttacacgtgcaattgcttgcataagattatgtccactcataggcttgtaaacatacattgttgctaatgaagggacatcaaatccagtaagccacatatcaacaacaatagctattttaaatggattattattatctttaaactttcttgcgagctcatctttatggtgcttattaccaattatttcacgccattcttccggatcattattcccagaagtcataactactccaactttttcagtccaagatggacgcaattcaagtattcttttataaattttcattgctattggacgtgaatatgcaactatcatcgccttaccagttagtaagttttcacgattgttctcataatgatctaaaatatcgctaaccaatgaattgattgtattgtcatttccaagtatagcttccattttaccaagctcgtgcttacttttttgaataacttcttcatcggcgtttgcagccataatatcgtattcagtatcaattagtttaagagtttgttcgtcaagatttaattttataactctgctttcataatatactggccgagttgcaccatcttccacggcttgagtcatatcataaacatcaatataatcaccaaaaacttctctagtgcttctatccttagatgaaattggagtaccagtaaatccaatgtatgttgcgttcggtaaagaatttcttataattcttgctgtaccaattttaattttacctgttttttcatcaactttttcggtaagtccatattgtcctctatgtgcttcatcagccataacaacgacattgcttctttcagaaagtgcatctttagattcttcaaatttttgcattgtggtaaaaataataccgttggcttgcctgccttcaagaagagtttttaaatgatctctgctttcagcttgaattggttcttgtctaagaaagtctttacattttgcaaattgcccgtaaagttgattatcaagatcatttctatcagttataaccacaatggttggactatccaaagcttcttgtaacaaatgagcataaaataccattgataaagactttccgctaccttgagtgtgccaaaacacaccacctttaccatctgtaacagtcgcctttttagtcgattgtatagctttattaacagcaaaatattgatggtatcccgctaaaattttatatgatttaataccctcattagaaaaacaaatgaagttttttataatatctagtagtcttttcttttgaaacatcccaaagaaaaatgtatcaaactgtgcatattgtgtgttttcataattaccatcagttgttttccactccataaaacggtcttcaccagaagttatagtaccggctctagaagtaagttgatcactcataacacaaattgcattataaataaacatcgatggtatttctttcatataattacgaagttgtctatatgcttcagatacatctgtttcttctctagatggtgattttaactccacaaggactactggtagtccattcaagaatagaattacatctggccttttattactgttttcaataaaggtccattgattagcaacaataaaagagttattatcaacatttttataatctacaatataaacaatagaagaacactcttctccattatctacataacgtactggaataccattttgtaagtaatccataaaaattgcattttgacgaatcaactctccattttcaaaattctttaatttgaataaagcatcctgtatagcatcatcaggcagccctctattcaatttatataaagagtctattaaaacatcttcataatatggaacataaaagtctctttctatatccggaccatatatgtattcatattccaaatcatttttaaaaagctcaattatagaattttcataatcagcttctgaatataaactcggcatatttactgcccccttattcttgataatcgttctgtaactcttttatcttgtacaaaacttcatcaacaattgattttgctgtgtttttagcaataacaagatccatattatttctgcgtaaaacatccgcaatggcaaagcgcatcttacttaatacagactttcgattataccaatccactgaaacattttccataatcgcagtggtgcaatcatcaactaaaaaacgattgactttcgccgtgactactccattaactatttcatataactgctcattagaaatattatcttttgtttcaattgatatgacatcatttgacataggaatttcgacctccataaagctagaaattgttggtgatgttatgttggatttgcttttctttatatatgccatctgatgctctaactcagggaataatgacccttcattgatgttgcaaaaatcaagttcagatagaattttgctctttttatctgatggaataataaagtactcattgttaaattcagaccttgtactgctaattgcagctgaaattacactttttccgatatccgatggatttattgtgatattgtactttcctgccaaaataaatgaaccgttttgtctaatcaatcgctcattatttaaatttgaagatacaaaataattactttgcaacatttcaattaaactcttatattggttctttctgcaattttcagcacctttttctgtatatatgtgttgcatttctaaataatcaagaaattcttggagtgttagattactacctacacaaagaattgctaagcaagaaattacagacacttccatatccatatggtttttaccatatgcttgttggtaaaagaccacaccatcagtttcaatatcttgccctgtttccaagtctttttcgatatgtggctgacaagcaaaatataaagcaaccagtggatttgcagttacatccaataaacgagtaggtaatccataatgttgtaacttcgctaaacgttcaaaatctgtcgacaacaatctaaattcggacggatttcttatataagcatttcgaaccatttcggcttcacttgctaaatactggtttctaaaaataattggagcaacatcccaactcgcatttgcttgtccacgaaaatagaaatttctgttctctggttcttcgctttcatccagattagcggcatcccttatattaaaaatctctttcataaaatcagaaagacattctatttgaatggcaccatctgaatattcatctataggtaatgacaatttattcccacctttcttaatttataaacaataatttactggagcaagtgctaactttatatcgcaataaatttgtcgatacagtcaacgataagcgacaaatttgtcgtgctgacgaatactttgatatttccatcggtaaaacgccaccgaggaaagaaccgcaatggtttagcacaaatcctcaagatgttacttgggtatccatatcagatatgggaacttgcggtctttatatcaatagcagttctgaacaacttacaagagaagccattgaccgccataatgttaaaatcgtacctgacaacaccgttttgcttagtttcaaattaacggttggcagaattgcaataacagacggcgaaattaccaccaacgaagctattgcacatttcaaaactgacaaaaagaaaatcaatgaatatttgtactgctatctgaaatgctttaactatcaaacaatgggaagcacatcatcaatagcaactgctgtaaactcaaaaatcattaaaggtatgccttttgtagtacctaccgatgaagaaattattgaatttcaccgtttaacagcacctatgtttgcaaaaatcaaggcaaaccaaactgaaacaagcaatttgactaagcttcgtgatactcttttgccaaagttgatgtcaggcgaacttgatatctccaatattgacctttaagccgttaaattattgtttatctcattattgctttttattttttcatctatacttgtaagaatacttaccataatatcttgtgtacttctttcaatcataggaattggcatttttccaagcgtttgagcattgatatttccacgagtactacccgtattaaaagagttaatccaatctttatatggcttagactgacaataatactttatatattttgggttaactttattttcatcaatactgaactttataagaaatcctgcataaacaaattcaccatcagacccatcgtaaaagtaattacgaccggtacttgccccagttcttgcaaacacaatatcatttggttttaatagatattcttctgccttttcatcatctactgattttaaaccgtttttatttaatgttccatcatcatttatatccgttattcttaaataagtatataattcgctcgaaaatggaacggcactagctccaataccataagaacctttaccatctactgataatgatgctaatgttacaatttgttcaatcataaccgtcctcctatccaatatatcttttatgtgctatcttcacattactttgcttaaccattgcatattgcaatgttgtatctatcttttgatgccctaataacttttgaagttgttctattggcattcctttatcaatagctttagttgccaatgttcttctaaacttatgtgggtgtgcttttggtatttctagttgtttaccaatatttcttacaattgtctcaatagctccaatcgttaatcgattatatggttttctcattgaaacaaataaagctttattttcatcacttctactatctatataattttgaagatgaatcttagttcttgcatcaaagtatactattctttctttatctcctttaccaaaaacaacgcattctctttcattaaagttaatatcatcaatatttaataaaacaagttcaccgacacgcattcctgttgaagctaatatatcaattaaagctaaatctctaagactattacagttatctctcattaattctaatgattcatcagaataagtttctttaatagtcgtagccgatttgactttatgtattctcctaactggacttttaactatataatcttcatcctcaagccaagaaaagaaacttgataatatccgtcttatattatcaatagttactctactagatttatgaacattttgataatcagttagatattttcttaaatcatcagtagtaatgtgttttacatgtttttggatagtatttagaactatttgaatagttgactcatagtaatgcaatgttttttctgaacaaccttctaaacgtttagaagataagaaagattcaacatagtgttgattatcttcaccatttagttcatctttgatttcttcaatcttataatttactaataccatatctaacacttcttttagtttttcatattgatcatctcttaatagatgaatcatactttgtaagacttcatttttaataatttctttcatagtcattctcctcttactaaattagttaagaacgactagcaacggctgtccttttacattgcctctgccgttgatagaagccttttattttttatcttttatctctttcttttctgttttttgcagttcgaatatgatctttagcttcactaagccgtagatcaaaatgtttttgtagtaaagttataatctcttcttctttcaatgtcgaatcaactaataggtttagtgtttttaataaacacacttgaaatccattttcaaaagactcatttatttctacatctttcttatcaataaaatcctctcttacttcatttattaaatttttcaacacatctttaaaattcatacaatctcccttcaaatctttgaataaacaataatttagctgcttaaagatcgatttcggacacatcaagctcgccggacattaagcgaggaagcaaagtgtcacgcaaatccttaaggcgctgattttccttttttagctgtaatcgttgctcaaacattggagataccgtattttcaaatcttttcacaattgcttcatcaataggaaaatcaattataaatgagtttatatcaccttgattgaaaccagcttgagcacttcgcccgcctttattgtttattccttcatagaaggttcgagatgataaatagcagcgcaaaaactctctgaaatagggttgctttggaaaaacttttgcaagtgctacattatacgcaccattgattccgaaacaaatcctacctaaagaagcaccatatcgagcaatcattatatcgtgttcttcacatattttgttttttgatgaaataggtatatatgttatatgactatctgtatcataatctctaatctgaacaaaacggatatagccttccttttcaatgttaataaattctgaagcaggaggctgacttccaccagcatagtccattaaatcagacaaagatatacttttcgtcgcaatatctgatggaacacggaaagtgttctcatatagaacttgagcttgctgctctaaattattgtttattgcattgttaagttcaattttttcatctaacgatttcaaaatacttgcaactttattttgcgcattcaaatcaaacatcggaacttcatactgcattatcgaggttttgtctcctcgtggcatttttgttccttttgatgttgccatcgaatatgtgaaaaaatcatcatttgcaagtacataatacaagaaatttctatctgtatttgacttaggcacaaaaactaatacatcattggaacaaccaccattatattttgcttgccatatttttttgaaatacggacgaatattagaaacaagaacatcaccttttttatattcttgtactaaagaaacagttggtaaagaactcgcatcagtaattccacacttatttggtaacatattctccgttgatatgtagtttttcgtatttaagttttctatatctatttttcctttacgaaaactacaaatatccaaaagcttacacttcatacccaatcgcccccaatttcttacgaatctcttcctcaagctcgtgtgactttgtaaacatatcagaaagttcagaagttaatcgagtcattttttcttcaaatggttctccgtcatcttcttgttcttcaattcctacatagcgaccaggtgttaatatataatcttgttttgcaatatcttgtatatcacaagtagcacagaagccttttatatcttcaagtgttccattttggaattcttcaaatgtatctgctaatttttgaatatcttcatcagtaaagtctctatgtttacgatctaccatatagcccatttttctcgcatcgataaatagagttttacctttttgttttttatttttgctaataaaccataatgtgaccggaattgtaacgctatagaataattgtgtaggaagtgcaacaattccctcaactaaatcggcttcaataatattttttcgaatatctccttcaccactactttgagaagataacgcgccattagccaaaactaaaccaatttttccattaggtgctaaatgatgaatcatatgttgaatccaagcatagttggcattgcctgcaggaggtgtaccatacttccatctaacatcgtcttttaatttatcttgtccccagttcgaaagattgaatggaggatttgccataataaagtctgcctttaatgttttatgcaaatcattaaagaatgtatctgcttgatatgggccaaagtctgcatcaattcctcgaattgccatattcatttttgccatcttccaagtatcagcgtttgattcttgtccgtagacagcaatatctccacgtttaccactatgagcctgaataaatttagcactttgtacgaacataccacccgatccacaacaagggtcataaacacgacaatttgcaaaaggttttaaaatagcaacaattgttttaacaatacttgatggtgtgtagaattcaccaccttttacaccttcatacgctgcaaattgctgtatacaatattcataagttctacctagcaaatccttatcattttcatcatcgttcatatgtatatgattagtaaagatatctactacatcccctaaaactcgcttgtccaaatccggacttgcgtagttcttaggtaaaacatttttaagagcagtattttctttttcaatagctctcattgcgttatcgatcgttgttccaatttcaggagtatgagcagaagatgctattttgctccaacgagcttcttccggcacgaaaaatacattttccattgcatatgcatctctgtcatcctcaaatccgtcaccatcagctaccaattcgttatatcttttttcaaaggcattagatatatagcgaagaaaaattaaaccaacgataacctttctgtattcagctgctggaatatgcccccaaagaacacaagcagcatcccatatttgtttttcaaaccctatgtttgcattgtttttttcagccattattttatcctccaattattcttcaaataatatttcgcatatatcttcaatattgcaattaagtgttttgcaaatctttgcaaggacttctaattgaacggactcattcttaccgagtttagccattgcatttgaagagatacctgcttcttcacgcagtttagttttatttatattcttatctatcattagtttccaaagtttgttatacgaaatagtcatcatattcctccgttcttttataacaattttactcattataccactattttctttatttttcaattttatttcatatattacaattcaatatttaacttctcaacgaaacattttatttttcattatttgaagaataggatgtttttatggcaaattatgaaaatttaattatttttttaatttcacccgtacgattacccactttcagtccaaacaagtgatgggacatttcattcacaaatatattctcttcaaacaacacaaagaaaggagcgaaacaaatgaactttgaaattacaaaagcaagcgaagtcaaagtacgcaaagtggaatggttatggtatccatttatcccttttggcaaagttacagtcattcaaggtgatgcaggtgatgcaggtgatggtaagagtacgttcatcttaaaacttgcagcaatgcttacaaatggcgaaccaatgccatttaccgacggaaacaaccttgaaccaatgaatgtgatctaccagtcaaccgaagatgatgcagatgatacgatagttcctcgttttatttcagctggctgtaatacagaaaagctattattcatcaacgaaaaagaacattaccttagcttttctgatgaacgattgttagaggctataagagcaaccaaagcaaaacttatcatccttgatccattgtctgcctatattggcgaatcaacttccattaactctgcaaatgaagtaagaagtcagtttagaccacttattgacattgccaaagaacaaggttgtgccattgtgattgttcaccatatgaataaagcaatgggtcaaaaagccgtgaatagagccgttggatcagttgatattgtcggtgctgcaagaagtgttttaatgatagctcgtaccgataaagaacgaccaaatgaacgcattttagtacaagtcaaaagcaatctttctcctaccggttctgccattgtttttagtattagtgaaaatggcatcgaatggatagaagaaacaagcaaaacagcagatgaagttttaggcaatgcattctcgtcaatgggtagaccagatgaacaaattcaaaaggcaaaggacgttttatcaaggttattatccgaccacaaaccaaaaccatagagccttataatggaacaatttaagactatgggtattagtgaaagcaccgttaaaaaagccaaagcacagcttaatatccgttctgtaaagcaaggcacatattggtattgggtgcttgaataaagcaacttaccgacaaaatgtaacttattacttccttcattcaaaagaaaggagcgtctatggaaatacaagaaatcaaaatcaaagattgcattgcttttaaagataatcctttcaagattcgagacactcttgatatggaattactcgttgaaagcattgctgaaaacggtgtactgataccgattgttgtacgcaaagcaaagttaaaccaatatgaagttatcagtggtcaaagaagaatatatgcttgtcaaaaggcaggtattgaaagcataccagctattgtagaagaactcagccgagatgaatctattattatgcttgtagatgcaaatctacatatgatgatccaacgatgaaggttatctttaatcttttattttatagtggtatccgtgaaggtgaaatgcttgccctgacgcttaatgatttcaactttgaaaacaacacattatccatcaacaaaagttatgccgttgtggataagaaagaaattatcaaagaaccaaagacaccaaagagcaaaagaattgttgctatatcattaccaattatgaatcttgtaaaagaatattcgcaaacaatctatggttacaagccgaatgaaagattgtttccaacaacgaaaagttcactctatcgtgcaatgaaaaaaatacagcgaactagccggagttaaaaagattcgtattcacgatttaagacattcccacgcaagtttacttattgaaaaaggcgttccacctcttgcgataagtgaacgccttggacacgaagatatacaaacaacattaaatacctattcgcatttatatcccaataagcaaaatgaaattgctgatatgttatcttcgcttatggtttaatttaaattgtattgataacgaacattatattacaaataaaacctctgaagctcctataattaggaaattcagaggtttataaattaaagaatctaaaaatacaatcataagttttatctcgcaccaaataacaaacttttacaacttagatatattattttctttaagttttacatattaagatttaacacaggcaacaaaagtatcctttatttttttatttaaatctctcatattactaaatttagaaacatcaatctgactgacaatagtatcgtgtaatttatcgggtatatcctttgaaacaaacttcttgtatttttcaacaatttcattaactctaaaatgaacaaatttccttttatcttcatctgttaataaattgaaaactcctttataatcaaaacgagacctcaattcgggcgatatctttgttttgaaattttccttagaaatatttgaagtaaatacaataatatatccgttagcatcatactcatctgcttgggaattaataattttaccgttctcaagaacatccaaaaaataattgaatactgcgttatctgccttctcaaattcatcaattaatattaaacctacatcagattcgttaactcttttaagtaattcacctccgtcacttccgatatatcctaaaggactaccaattagactgttaagtgcatcgtgactgctatagtttccaaaatttatttttgctaactttgttttgcttccaagtgccttatgaatagttctggcaacctcagttttacctacgccagaatctcccatcaaaaacaacgataatattttatgttcccctagtttattaaatactctaaatgaagtaaccaattctttgaattcttctttaaaacgttcgtgaccatataatcttgaatcaaaagtagaaaaaaacaaattcagttctgtttcgtttaaatcagttatttttttgactgtggatgattttgtttcttgtaatggtttaacttcatctgtattttcgctgattttagtttcaacatccctaaaatcatcaaatacatatcgaaaaagatattttgcatctttctcataagctttatcacatataaaataattgttttcttccaaactatttataagttgttcgaaattaagcatatgtaaatcattattttttatgaaatttacaatatatgaaagatcaatataatattgctgatgactatctaaactttcaattttttgagatgaaagtaattgagacatactgataaattcaaacccagcttctatttgctctgttttaaaattaaagaactgattttttgtgtagaaaactagttcactcattcagcagccttctttctttttgaagtttttttcttcttttccatttcagtattctctgaatttattacctgaactatcgcaagaagatcaatataattataatccaattcatcactttcacttttcattttagctttatgagattcagtgtattgactattatgaacttcgtcatctgaatcagattccgatgcttctcctaattcttgaaagaattcgaatgaatttttcaatccgttaatttttatttttcccttgtagattccaattaaagatacatttccaataaacaaatcatctacattatatgaattttcaaattcattctcaaaagtaagaggaatttttatcaatatttgctcatcaccattattaagtttaccctttagtttataagaataatctttaaaaatcgaattgaacacattgttgatgtcaagtccaccggcttctggtaaatgcatacctttaaaagaaccattagaaaacattttaacagttcttaattccgtttcattttctaacgaaagtgatacattatcaattcgaacaagctgtccttcagtaagatctctaaagtcgttaacaatcttacacttttctaatacttcatttagaataagtgatttagtcattgttactttaaaattttcaagaactttttgtgaatcagttgatcctgttttaatgtcggaaccaatttctccattaaaaagttttaagaactttgttcccattttagcctgtaattcagcatcgatattatcattatttccaacttcgacactttggtctgtttttattacattactaagcatcatttttatttcataaacttttgtaaaattcaaataataaatattaaatagcattatatcagtttgacctccaacaaatttgatcattttctaagcaaaaacaaacaagcataaagaatcttgtataaatatctactcctccttatttattaatatcttgtttttctataacctaatttcatatttattccgtgttaaaatttactatattggttaatataataagatttcttgatttgcctattagtataacataaaaattattcttttcaatgtacgataaattttatgaaattaaatacctattcgaatttatatccgaataaacaaaatgaaattgcagatatgttatcttcgcttatggtttaaactatgggaataacgcatcttctctctaggtggtacacttttggtacgatgagaggttttaattacattatatttttattccagttcaattgttttcgctaaaattaataatagcatctcctgatctttaaaattatttgtaaaaaataccccttctacactatcattaaaaacaataatatcattataatcgatattatttttatcaatttggatttctgttatgtcatttatctcttcaacatatacttttacatatttatatatttttgctttttgcaaaccttctatttgctctgttctataaaggatatacccactatgattgaacaatgcagtatctatatctgttggatcactgttttttagaacaattttgttgtgataatccattttcattaccctttctgtatccacacaattcggcaaattcatcattcgttagttctaatgcttcagcaatagctagcagataatcaataccaggatttttagttttaccattaattattttacctaaatgagaatcgtttaagtgcgtaatacgacttaatttgttaatagaaatatttttttgttaattatatttttaagattttcaaatactgtatttttcttgtaacagtgcaaagaatcgaagtctgaagatacattgagtacagtcttcactttaaatctatcggattctagtaatgttaacgcttcttcgatagatttattattttcattataattgtagtattcaccaaagtcataaattaacagttcagcttttaaaacatttgcgcagttatgtgttaggatttcgtctctttgatttttgaattttggatcatcataggcagtcaatgcagttaatatttccagtaaattaaacccatcattatttttcaatttcattaattcatctaataactgcaatttatcattactgcatgctaatttttccacattacatttgaaatcttctttttttgttgacattattcatcattcatttctgtatctcaacatttgaaataaaactattaaaaaaatattattataacacaaactttatctatataacgaacttctccactccataaaaaatgaggatattcacaaagacactcagttaaagactctgctatttcaaaataatcataattgaaagccacttttaattcattatggtgttttttagccagcctaatttattcttgattttttttcagataattttttccatgcaataattctgtcatattcatctccaaattcttgccattccccattttcaaatctcaattttaaaatatcacttgaattatccatacaattcattacatatacataatatgtaccatttacatttggattgctttctaaaatactagtccatttatccactctttttatcctcctcattgtcagtctcaataacctttggaataaaacaaatttcattatatgaaatagaatttacactatacaatctctacttatacttaattctacttctaccttggcattttcaatgcctgcatctctaaataatgtttttactgtatgtaaagcatacagtaatcttccttttttacttaacattggtcttctccttatttcatttttatttcttcttttaatttatcaaacctatttctctttaaaatagatttcttatattgctgcactctataatcataacaatcatttcatttgctttttcttctactgtgttacaaagtccatcgattacttcttctttatctatgtcagcttggaatatatttttaccatgctctaagcttttttcttaaactttccattgctctataatattgttctctatcttcttcattttcaaaaatatcatcatcttcatatcgtatattttcattccataatagttccttcttgttttaataattttgcaataactttatctaattaaaatgacatagaatgtagttaatccatgtaaactattatttcatatggaaattcacattcattcccactttcgtcaacacgtttaattaatcttttttatttgttaacaattggtctttaagaccatttttcttcacttctttttctttaatatttctatcttcttttcttgcaaaatagtatatatttctcatttttttatctccaattttctattcaatatcatcataatatccatagctagcagaaacatacatagcatcattgaattctttgttaattttatcataatttttatctagccatttttgacgtctttcttcatcccatttaacccacgattttggtacatcatataaaatagaaagatctccattatcggcacagttatcgttattatttgtaaaaacaaaactgccatatactctaatttgcattattttctatcctctctattaaaataaattccttatattgctgcactctctaatcataacaatcatttcatttgctttttcttctactgtgttacaaaatccatcaactgctttttctttatctatgtcagcttggaatatatattcttcgctacttgtacaataaggcatcaaataattaattgtacatacattatcggatactgtgatatttgtaatttctatttcttcatttttcaatggtttgaatacttttttccaatacttctctaactttttatctggtgaaatagtatttctgttttgtggatcatcatttttaccaggtttaactccaataaacatcaaatgtgattctaaatcattttcagaccattcaataatcttaaaattatatacatcagcattttttccataaacaacttttttttaagttactaagatgcttttctgcaccttttagtgttttaaaaacttttggtttttgcttattaaagtaactgcttggataaagataacacccatccatatcactgtatgttcctggataaatttcagtattatatttaattacatacattttcattccacctctattcctaactatcttctaaaacacttaagattgaacgcacgtaaccatatgctctctcacgttccttctgttcttctcttgtatatctgtcataagaataaccatgagtattggtttttccatagccacgaaaacacaattcccgacttagcatcgaataataatacgtgaattcaaatttaaactctttatatgtgacatatatacgatctatatcattgctatatatgcttatttcaatgtctgaatcaattttgttaatttcctcttgaatatgctcttttattaataatgcatatttttctttatatttttccagttcagttctaaatttctcgattttattcatttcaattcctctttttattcaacatcgtcataatgatcataaatttgatttacacctatagaataaatgaacttttttcaattttttcactatttttttccagccaggcttgtcgtttttcttcattccatttcatccacaatattggtacttcatacatcattgactggtttctttctatatttaggcttatttatccctctattccaaaataatattttttaatatcttcttctccaaaacatgatactatttcttctaatacttcttcgctttcaaaatataaaattgtttcttgacactccacatgctgatcaatctcaacgctattgtcatcatggtcgtaataaagaaaatatttatcttgagtacaatctttccaatttggctcaaagtttttagattcctctttaaatgctttttgaatttctaaatatcgctcgcattcttcgccagttctaaaaattcttaaaaaggttttacggtaactatctactccactaccacaccattgagtaccaacaatatccccatatgaatcaacaaaccaataatcttcattatgttttggaaactcatcatcttcaatttccgcttcctttaattcctctaattctttttctagctttgctattctttcttcatattcttttctattcatcttacattacctcacaattacttaatatttcatcgatgttgtaaagttcttcatcttcccatttaacaaaattaaatgttgacttgaacatgcctacataatcacaactactaaaccacgttgaattaaacttttcaggtttttcgctagttccatacaatctgttatcttcatctcttgcaataaaattaaatccctcttttttagcaacttttagatattcatattcaaaccaagtaagttgaattggttcaggttctttatatttttctaataactttaacaatgatatttttaagcatttcgaacaaaccatattatgacaataattatcggtcttttgggaatttgtcgctatttgacacaagtagtaatcgagacttttgttatcactatcaaaatctttaatttcttctttaattgtttctatttttaccattttttaccacttgtattatttaattatccgatatctccggtatttaaataatattttcctttcctgggaattatttattatttaatatttattttgggctgtggatttgttttttttcactgtggcgtagaccattttaaggagtatcggaccacagttttttatttacagctttgattagttagataacacctgatgtttcatttctcacaagattaagctcatgtaaaaacactgtgttcaaagccagcccatatatcacattcataaggaggaaacttatatgtattatgtcggcattgatattgccaaatataaacacgactgtttcatcttcacttctgaaggtgagattgtcttagaatctttcacttttgaaaatacaagagaaggattcagtaaactcaagttaattctagacgcattagatcattcccaaaaaatcaaaacaggtctagaagcaaccggtatttatggaaagaatttaaaactctttctatcatctattggatatgactttgacgaattgaaccctcttcaagtcaaacgttttactaacgctttgtccaatagaaaaaccaaaactgataaaatcgacgcttcccaaatagcacgattcgtatcaacaggtgcctctagaacctatgtatactcatcataccatactgaagctttaaaacaactaacacgtgctagaaattcattaatcgacgaacgtagtaagcatcaaacagtgcttacaggtattctcgatgtcgagtttcctgaatttaaagggttctttaataataaattcactgatacagcgctatatcttttaaataaatataaaactgtaaaacgtattagtaagttatctcataacgactgtgtattactgcacaataaatccagagtaatatctacatccagatttgaagaattaagagaatcagccaagaatacatgcggtcatcattttgactacaacgattccttaatctccgcaaatctacaaataataaaatgtttaaacaacgaaatagataaaatagaaaaagaaatcaattctatcatgtctacaattaactcaccagtagtaagcataccaggtatatcagctatatccgcaacttctattattggtgaatttggagatttctcccgtttcgataatgcaaaacaactgtgtgctttttgcggtgtagaaccttctatttaccaatccggtacttcgtaccatgaaggtaaaatggttaaacatggctcatccaatctaaggcgaaccttatttaatgtagtaccctacatcatcatgcataacgaaacatttaaaacattttatgataaaaaaagtagcgaagggaaagcatatagagtcgcacagtcgcatgtagtaaagaaactgctgagagtaatatttactcttgagatgaccggcagtacctttaccccttcaaaactatactaaattgaactaactgaacaatttttaaaaagtgcattctatgcgctgttttcagtgcgtccaaaattgtcactataaaatttctttaaaaaaatctttacttcttaatagttagctccttataaatgccaggattcctgcaaatgcttcatttctccatttttctattctttcatttacagttttttcaaaataattaatattcccctcataatcatcataatttttatttaacggtgataattttaatctgaatttgtttttaaaattgatatcaccattatcaagagtattcgaaatactatatatcagtgaatttagttttttattgtataaatcataatcatcactccagaaaactgcatcctgcagtaagataattcttaaatttattcggttgatcactgcgttatatagatttatttgctgtaaccgttcatcgctatatccaaatttgcgcctacagtatttaaattttttatatgtcttgcctagtgaggtaataattttagataatgcaacgatgtaaaatttttcaagttttgcaataaagttgttaaaatttcttttcttaatacttttgtctctatgatccttgtaccaaagatgcctaattttcgttggagtcacatcatacttttctactatgacattcccgtctttatctttcataatttcattttttttgcatatcattaccatattaggatcatcttttttgcatgtccttcctgtaaatttatttatgtacatatttcttttgtatttttttggattagatataggttttgtaaatacttttctttcaaacacaagaaaatctatatatgtcccttttcgaacatttttaaatttataaacaaagggaatagatttataatctagacttatattaaacataaactgtttcgcaagttcatgtttttgctgtttagataatgatctggaaatcatcactcttaacttaatacagtaattctttttagttgcatttctttttttctcatatgcaattagcttgtcaattttagattctatatttgcttgatttgaataagccttagttttgataaaagatttaataatggctgtatcttttattgttttatactcaatgtagtttccagaactgagcatgcgtctcatatctcctctctaaatcaacatcaaagggactttgatgtttttatttttttgtcaaatctaaaaaattatcatttattcagttaaattttaatttttttataatactcaatttaatgttgttttttaatttttcttattacttttgtgatctgctctttatgattaatgcctaattttttcgccttgcctttcaatgcgcttatgtacaaaaacatcagccaacacaatattataaaaattaatattccaatcagtatgattaagataacagtgagtttatcgtcttttgataaactctcaaacttatatacttcaaacatattaatcatttgtaatcacacccatcatttgcaacactctgtttaaatcttttatatccacgcaattaatagtaatcttattattttttgttaccatacacttcgcatcaaaataatttgttaatttcatacggacttcttcgtaatgaatacttagatcatctttcacaaaatcatcgatagatgtttgtcctgtcagtacttcatcatcattttttaccttaggatcttcctcgatttttttctttatttttgtcaacactaactgcagcgtctcaattggtaatcctgatttgtggataagataatcatttctctcttctatatttacaagatttctgttcacatcatccttaaattcgtttaaatacattagtacagtattttcaagttcatcaataaaatctcctaccttttttaatcctaatccactctgttttgaaatgaattctctaattcttcctttaaattctccgtttttattgagtactgcaacatactggtaatatgctttaaacaaagtatatttcttttcttcagtatcaaatctacgataatcattgtaagtaagaatagtattcatctcttcaatttcattatctggtttcttaacaatcgttgcgactattgtcttttgaacttttccagtaccatctaattcactctcatgttcaatattatatttgcaggctttaattcttttatgaccgcttaccaacatatacttaccatcactatcacgataaactgtaataacttctaagactccatttggattgtgataaattttatcagcaaactctacaatatcctccagtgtatcgaaatctggatttaatggattatatttaatatcctctattgcaatcggttctaccttttttcttttatcaaattccctcatcaaatcctcactgttagatttatcatattgttttaaattaaattctaatccgctcatactatctcctcgccctcttttaattttatatacaacggtttcattaaatgaatacatcagttttcttataatgttctgtaaaatataataaccattggcaataacaatacactcatcgcagaacactactccgtttctaagatttttaatacacattccatttagaaaataataatagaaaaatcttttttcactttgtgttaagattcttgatgcacttaataataatttcattattatttcatttgcactatttactactcttgtttcaacaagagtagtaaaatcacaaattttttctacttcagcaatatttaatttctttacctcataaaaaccagatttaataactggtcttaaatcttcaataagagtttttgtattctgctgtgttttttctttatcgatgtacggacaaatcattaaaatacacctctacttcatcaaccaatttctttaaatcattaccaatattaagatcactgtcgattaaaaattcattttggatcgtagcactgttcgcaggttttgcacgataccgaatagttgtgtctaatgtttttccgctaaaatatttatggaacagattaacaattcctttttcattgttattatcattaatcatcgtcaacaatacttttaagtcaaaattaacatccttcatttttaagagcttgcttacagaaacaattaatccttttaaagaacctctatctggtttaacagggataatcactaagtcagcaactcttagtgcattgctcaaaataacactgtcatctggtgcctcatctactattacaaagtcataatcatcttcaatatatttaaacgcagactttaaatatccagttatatcctgattaaaattatgaagtaagcttattttcgcatcaccaagtgataatgcagaaggtattaaatctaagttttttattcttgttttcataattacttctttaatgtaactaggttcttcaaaaatatctttcagattaaaattaatggtgtaatcactgtataaacagtcattcaatttatttaagaaatcttcctcatttttaatatcatcattaaattcattaataaatttctcatcaagttcgtttccaatattgcctgcaacatctgtcgcatttgcttgtggatcgctgtcaataagcagtgttttatatcctttatcagccatgccttttgctaaagatagtgcagtagtagttttactaactccacctttcatatttgtaattacaattgttctcatatttttttcctcttttcctttttttaaatttctttgatcataattgcatctgggatcagtaatgctaaacgatacttagcctccctcaaccgtttataataactatttgtcgatatgttcatctcattcttcacttcctctcttgtgtaatttaatatttctctttttatcaaaatacatctgtcttccttatccaatttatttatacagtcaaacatttctataagaaacattgtttcttcattagatttgtccaacagatctatcattctgctttcatatttcttagaatcaacacttgatttcgaatcatccatttttaatatcgaagttgttgtaataaaatttgcatcaaaatctctttcgagattgtctattaaataaattcttatatcattttccttatcttcctcacatgctatttcaatgttgtatcttgccccgttgacgattcctgaaagatattccaataattcctgaatattctccattgtttttttgttatccaaaattatactcatcagtctccctcccaagcctacatagaatttttttgcatatttaaatttatattgataaaaacgacaaaaaaagcactttgcaaattagttgctaagtgcttctataagttaatattttcgaataaaaacaggtatttcgccccatttttattaaataatctaaaaaaataaaataagaagataaatcatacaaaataaagttatatactttatacttgatttcacagtcatttaagcatataactactagattttatctttccaatatggtaaatttctatataaacaaaccatatttatatattatatgatttattatcatatgtgtcatggttaagtgctaaatgactatgctcaatcctgtttcattggtagtgaaacaggattttttatttagttgtttcgactgtttaagtatatcacctgaaaacataaaaataaataaaaaattgaaaaaataacgatattaattataccactgcttgataatttaaacattttttaaatactcatatatcagtttatagagtacaactctatttttaatcaaaatatttctcaataataaattgttagacaaaattttatttgatataatacgtttgttatcgtccctcctgtttggagaggaggtggtataataatgtccgatttgattatttctgtcatggcaggtgtaatagtttattacatatgcaaatagttagacaaatatttataacgataactagcctagtgttaagttcactgtaaaaaccagaaaaggtaaggagtgcattccttacctttttgtttgcattgtgatataacaatgcccgatttacagatagattataacatttaatctattcaatatcaagtatatctatttttttactgtttataccattttttatcatatattttattaccgccaattctttccataatatccttgcaaagtaattgagatatgtaattttattctatttcattttgatcccatttccttcatttctcccatagcaatcagttccctgtttaatttaaatattgcgaaatcaatattcaaaacaattctactgcaacaattgaaaaaatataattatcacaatcaagaattctacagtacttaccatttcactagatctattatctgtaatcatcaatctgtttaaagaattatctaatacctataccatctttgggatttaatctattatttgtatttatttccattccccaatttttatttctatatgaatctttggatatcattcttttagtcgtactttctgcaatatacttcacattatcccactttctaaattgctttctagcttctccttccaaaatttaacttttaatattacatctctttgaattttaaatagtttcccacataatattagaaattatacataatttacagttctgcaatataatcatatatttttttcaattttctaatatcttttttactgtaactgcctttagtcatctgcatttttaaactcacctttagatcatataaatagtcctcaattttatttttttcttcacttttaataacatcttcaattttttgagccatttctctctgaattttattattcacatgtaaatacgtatccgtaatttctatattttcatgcccaagacgttttgaaacgttgtagacatcattggttatttccaacatcatggtagcatgagagtgtctaaaaccgtgcagattcatattagaaacattggataactctttatatttaataaaaaaaacgatcaagagtagaatacgacagcatttttgtatcaccaaagacaaaatgatgattaatgttacaactatattcagtcttcttattaaggtaataattaagcagcatttcattcaggctgtcattaatataaataatacgatgtgaactgaaagattttggttctttaacaacctgacctctacctcttacgcgacaggcagtagaattaattgttattgtctattctatcagttctacatctttccacatcagagacagtgcttcgcctttgcgcagtccagtatagaaaaaaacattaaacagtacatagaatttttcttcatcaacatgacttataaacctgttgaaatctccgatactccatataatttaacattttttatgtttttccttgtcaacaagagtatggatacgttttatcctcgtgactgctcaactgtcggtgtaaagcaattcattaaaacactatatttaatcaatcgtttaagcagttctacaattaaattaatatatgacaccgaaatacatcaccacttctacttccatagacaccttcaaccatatccttttgaaacttcttaatggactttggatcaattgcttctaattctatgtttccaaatacaggtttcaaatgagatttataacgatatttaatagaatctgtagtcgtaacctgattgatcatatcgacatcttcgatatatatgtcaaataattcatttaaagtcataatacattcctcccataaaaaaatcagctttaataatacattaaactgatttattatactaccagaatattattcaagctggcgttttttctttatcttctttttttctgaagtcattttatgggagtatttattaagcttgtaaaatgaagttttccagtattatcaagcaagttatcaaatatattcataggaaccccttctacctttttatctggatttatcttacaatcaacagcattatacctagcccacaaagattttttcttattgttaatgtttatacatcttttttcaaatttatctgattcttctaatttgcataccacaaatgaattgggcctgaatgtcaatatttctttatccgtccatgtcatgatctcatcaacacggcctaccctgaaatcatgctcaatatttttattatgagtcttcctttttacttcaacaacaacccaatcacctatactgattttctcgtattccggacaaataaaatgataaggcttgctgttgatattgatttttctagaaacacctctagcgagccttacaacagctatctgaagctcagttgtttcaatatttaaactctctaattctaataccatttctttcacctcgttataagtatatcatcttataaaatcagaaaacacgacaaaaaaaatactatatccatttcattaagtgcaattacctcaaaaataacatcacctaaaactactagctcaaatagaactattcaattacctagtaaaatagttgagaaattaaagcaaagatatatcattgtatcataactagatagttttaatgaagattactatttatataaagacgaaaactacatctctattgcgacatttagaagatgatttaatgaagatgttaaaaaatcttgtgttaaaagaattactgtacatggtttaagacattcacatgcgtcctatttattatcaaatccaacgatttctgaattattaattgctgatagattaggacatagtgttgaaatgttacgaagtacttatgcacatatttatgaaaaagcagaaaaaatctcatagattttattgatgaattataatggtcttgattacatattcaagaccttttactttgcatagcaaaagagcctcataatgaagctctctcatatataatcgacaatttataccttattcctttaaattagttccaaaagagttaaaccacgccctttgatgaaagggtattttctttacaggtttcatatcctctaatgctattcctacaggtaaaaaagcaacaagatcatattcatctggtacatttaatatttttgccattttatgacctatttgatctagatctgtaatatgtccttcaatccaacaactttgataacctaactctacaatagcaagtaacatgttttcaatagctgctgaataatcctggacagaaaaacatttatctctataagcatatattcttcttgtcaaaacacatatcattgcaggagctgtctctccaataggaggtttaataacactatgtagtttttttaatacatcctgatcatctacaacaattaaacttgtcgtttgtttattacatcctgatggagcagataatccagcttctactattttcataagatcttttcttggcattttttcttgcttataaccccctctataactatgtctatttatgattgtatcaattgtattcacttaaaaactcctttcatttatttattattaatgaaagaatcatccatatggagccaaaggtccatcattcatcaatttgaagtttatcatcatattatatttttccttttcaacatttatattttctttaaaaaactatagccttttttataaaattcctgcttttcataaaaagcatgtgcacctaaacgtgttataccactatttaaagttattacagacacattatgattttttgcatatttttcattatacttgatcaaattcttgcccacacccattttttgatatttataagaaactgctaaggcaattattctcataagtttcccagatatttcaaaagccaatccaaaatgtaaaccaataaatacaacaacttgtttatcttcaacagctacataaatacaataattctcatctttacacatattttcaatcctatttgcaagttcttcacaggaaacatcatatcctaattcgcactttaataagctgtgtatatcatttaaatcatctgtatcatataatctatattacatttttatcacctcgtttttataattatctaagaacttaacctatatatttacatacatctaataagctattacatttccttacatcattttcctttcctgaataattaattccatagaatgttaatccaaaatgtttagctaataaataatcggcttgactatctccacaatatatagatgattgcatatctatatcatattcttttaatgccttctctatcatcccaggttttggctttttacaacagtgatctaaatcattatgaggacaataataaatattcaatacattgattccattattttgtaaaattgttaataattttcccgcaaatgaataataatcgtttatcgaaataataccatcagctattatatatatattgatttgtaactatgataatttgaaatcctttttcaattaattttttattccttcaatagaggattgcagtcctctcttttcttttttagcaccactatcagagactatgtaactagtcttttttctttaactctacaacgataaggtcaacaattcgattattgactctagattcatgtacagaaaagcggtagtggcactttaggaaagtatttatgatcataaaatacctccgtttttcattataacatttcgaagaaaaattaaccattaaataaaaaaagtagattttagcgaactcaaaacactattagacaaaatagaacaaaacagttttataaaattaaaattaaatatttaacattgtttgcatcaaagaaaatcaagaagaaaaatccctctttatatcgacgttttttcttctgaagaacttaataaacgaatatttatatgatataattaatatgaataataagtggaaatatttataacatataaaatttattttagagaggggattttatgaaaaaaaaaaaataacaattatcattttcacgatttatttagcatttatcttcctatatccgttgttgagaggttcaatcgcacatattaacggttacccatcgtattttgaaaaaatacttaagtgtataaacataattccattctattttgattacactgtaatgccgtctgttattataaaaaatattatttttaagatttgtctatttattccagttggttatatgcttttcacaaaaaaacaaaatcaaattcaaattgtgaaaatattattattaataggatttttaaaagagacattccacttattaattttatacggttattttgatataacggatattttatattatctagttggaggattaataggatattatatacataaaataatattcaattggaaggtttataatgtttaaccgcatgaaagatatgtataaataagagaggggataataatgaaaaaattaaacattttaaaaacgtttgcaataagcattgttgttatatcgttgctttgtgctttttgttttcctataaatgctgtaaacgcacttacaaactatactgaaaacaaagagaacagatccattgaaacgttaaccataactgcagaccaaggattaggtggcgatatgggatatgtaacatgtaaagttattgtaaattataatattcaagctcgtacatataaggttgctggggtaacagtgacacctcacttttcaagcagtcagccattattaaccatgataggaaatccaacaaccacgccagacagtggcggattaattacaaatggctatgttacagttcattataaatttggtattatgttcactgattataaatggtcaaaaagctgtaaagtttatttataatatcttataactgaataataactatacatatctttcacatttcaacatcaacgataaaaaagttcagaatagggtgataacaatcatgaaaaataaagtctctaaacaggtcaatgaatatgtaaactattttcccaccaaaagagtaattattaagcctttttttaaatgccgaattgacacaacaaattatatgttattcaagcaaaatgaaattgaaatccactatgatgataatttatacactataaatcatgaacaaattaatgcagtgattttatcaatgtgtagtcgattatataatcctggaataattgaaaacaatcctgctaaatgggttgttaaaagatttaccaccggatcaatcggaacagttatgcaacctgtgatttataatgttgacatagacatactttgtaaagataaattcctacaattcgagtgtacaaatctagatgaaatgtcagaaataataacacatttaaaaaacataggcataatagttcaagattctttaggaatagaaaaactattaaaggtctataaagataaatatgagttgttcaaatatttagacagaacttttcctaaattagctaaaaaggaaaatttagataatcctcgtggtgtattaacaaataaataacatttatatcaaaagacagaattcataacaaaaaaagttcgtgatgtattttacgaactttttttgtaccaaatgttcttcagtcgaaccgctgaaccgttagaaattatgaaaatgataaattaactttgaaaaagtatagtagtcgagagatttctttagattttaaaaaacataaaaagctatatataccaagggtttcaaacaaaaaaagtatggttttactatagtatatctcccatagtaaaaccatagcaaaaacaatatcattaaaaatactaaaacaatagcagtgaaatacacattcaagctaataccaattatagtcaatagactaaaatttgctaagtatattcctacaagttttcatttaccaacacatgaacaattggatcaagttatcgatattcttaatgatagagataatgatagcaataaatattgctatgctgttaaaagaaacggaaaaataaggataataaacagatgcatcgtaccatatttaatgataacaaaacaagattattacgaccatctttatatgatcatttcaaaaacgatacaactgtaagcttttgttataaaccactaccatctgatcataaagacgattcaactattcttctgaatttttcaaaaaatcaaaagcagggtaagagccggaggtgcggacaatttcttggaccagagatgatgtaaaggaggaaaaaatatgtcatatacggaacaggaaaaacagcaggcacttgcactttacgatgaaactggttcaatagccaaagtcattaatacacttagctatccaactagacaaaatatgtatacatggatcaaaaacagaaatattgaaaaaagaaaaaagtagccgttgactattcagatacacctgagcatagaagacatccatcactggaattaaaattatcaatcattcgtcgttgctttgaagaaggagaagatataaaatcagtatcagaggaaactggttattcaagagcaagtatctatctctggagaagaaaatatgttgttgggggtgcagctgcattgacaagtgaaaaaaagcatttacctcgaggtaaaatcattacagatacgtccaatcatgatgctggtcaagaagaacttgtatcaaaaatcaaggaactggaaatggaaaatgatattcttaaggaaacaatcaaaatattaaaaaaagatcagggtatcgatcggtttaatttaaaaaataaggaaaagacaatgattatcgatgccctaagagataagtattcattgtcttcgctcctgaaaaggatgagcatttcaaaaagcagttattgctatcagcataagattatccattcaaaaggaaaatacgaagctataactaaagcaattttgcaattatttcataaaaatgatagcagatatggttatcgaaggatccatgccttgctgaaaaaacaagatatcattatatcagaaaaaattgttagaagaattatgaaagaaaatcatttggtagttaaaataaaaaagactaagaaatacagctcctatatgggagaaattacaaaggcagctgaaaatcttattaacaggaattttcattctgacagggcgaatcatagaatactaacggatattactgaattttcgatacctgctggaaaggtatatctttcaccaatcatagattgttttgatgggatggtatctgcatggaaagttggtacaaatccaaatgcggaacttgtcaacagtatgctggatgaatactacgaaacactaatgaatggagaaaagcctatcatacacagtgatcgaggagcacattatcgatggccagaatggatcagtagaatggacaggtatggatttcaaagaagtatgtccaagaaaggttgttcaccagataattcagcatgtgaaggattttttggaagaatgaaaaatgaaatgtattacggaagaaaatggaataatatcggtatagaaaaatttatggttcttataaatgaatatattgtgtggtacaatacaaaaagaataaaacaatcgttaaattatctaagtccaaaagagtacagacaattactggatcttaattgaaatagcaggtccaagaaattgtccgcacctccctctcactgcttgtttcagattgttgacaaagtggtactccaaacaggataccacttttcatttgcttcataagttctaaaaaatgttgatatcattcgttttataatgcttttagtagagatttccaactccaccttgccattcttttcagattatggcatgcaaaaatcatcagcgcctgatgctgatttttttgtagtcctcttactcttgtatatcttagattatgatgttccttacagtctccaaatacccgctctatgctttcttttcgttttggataaattttcttccatttcactgtatgtcttatctcatccaccacttcttctcggtacttctcccacatatgacgggtgattaccttttgatgattctttgactgcgtacatttctctctcaatggacatccttcacagtcttttggatttgacttatactccttataaccttgtttatttgtggtgctgtattctaatatctttatattagggcatatataacaatcgtatttttcatcgtatacataatcatatttcttcatatagcctttttttgtcactggtcttttatatggggcatacattttttgtccattttctaatatcatcttacaaatagctggtgtgatataccctgcatctaaacatatatttttgatcttatccttatattcttcacttaatagctgatatgcaggaaaaaacgacacactatcatgcacatttcctgctgcacaatgacttaataccacaaatccatttttatcacagaatgtttgatgtgaatatgcaaaacatttttctttttattctttgtggaaacagccgctttccctgtctgttttgcttacttttatatgtttgctcaccaggtcttttttgaggcttcctgtttcttcatcataatttaattcttctgcttttgtttcttttaatggtttttttccatgagcgatacgatcctcattgatttctttcaataactcatcatcatacactcttttcactatttctacttcctcatctgtatacttgtttttgtttgcatttgctttttggtgcgtagaatccccatatactgtttccaagtctacaaaaccatattcgatagcctgttttagtattctggtaaatatatggtgaaacacctcactgtctccatatcttcttatataattttgactccatgttgaatagtttgggactttatcttccatagctatccctaaaaaccagcgatacgctaaattgacttggatttctttacatgttcttctcatagaatgtattccaaacaatatattgatgaataccattttaaaaagcaccacaggatctatgcttggtctaccaaaatcactatatagatctttgactaaaggatatataaaatcccaatccatacatgaatccagctttctgacatcatgttcctgtggtaccagttcttctattgttctcattatgatactgtcttttttaatactttgtctcgtcattgccatgtgttatcactcctaattcgcaccttaattataccattttttcatcttcctttatataataaaaagcaagaagagcctcaagttttgcgaactaggacgaagtcatcttcttgccttttcattctatcatagttttctttctattcaaataaaaaaactgttgactttgtttatttactttgtcaacagtctgaaacaagcagttatatcaactgcttgtttttccaaaaatgtttatacatcttttttttcaaatttatctgattcttctaatttgtataccacaaatgaattgggcctaaatgtcaatatttttattatgagtcttcctttttacttcaacaacaacccaatcgactatactgattttctcttattccggacaaataaaatggtagggcttgctggtgatattgatttttctagaaatacctctgggagccttacaacagctatctgaagctcagttgttttaatatttaaactctctaactctaataccatttctttcacctcattattagtatatcagcttataacattaaaaaacacgacaaaaaatactgtctttatttcaataaataatcatatttcacaagtgtttgattattgccaatatttaaaaatctatttttctttattaattttatcaattagccattttccatctttttctaccatctcaaatttaaatgtaaattcggtatacttagcgttgtctaattctttatataacggattatataactcttttgacaaatcatcaaaaatctttttcatcattgcttcttgtccctgttctaaatatattttagataactcttccatattttcttcttgatacttctgagccagttcattaatattttcttgtgctgatgtcatatcgattgatttttcatctagtctttttcctttaaccagtacggtattttcttcttcgtcatcaaaagttattttatactcttttattaatttatcaaagacttttttaacaaagttttcggtttctttcacaaaggattcaccataaacattttcatcttcaaaattcttaaatccatcagttatagaactaatatcaagtacatcagtataatcatcagttcccagcttttctaattcatctagcttgtattcctttatattatcaaaaaaagatgtaactaccttttcctgttctttctgggtgttatcgtttccagcacatccagtcatagaaataatcattaatgctgccaaagcaaatgttaaaatttttttcatatttatttcctccaaaaatgcaatcaacttatcctactagcaataaatcaaaactataatacatttatccctcctgctatcaaattagccaaccggcttatactaaattttaacataaaattacatacttatgtctataaatgataaaaattgtttttttaatctatttaaatataaaggtacatcattgttagtgtagaataaagatttcataaaaaacatctctgttacacttgaaaatcagtaaaataaaatccgttgtatgcaacacctatagatataaaaaatctgttatttgatatttctgataggacatttactcgagcatatgctgctaatacataaaatgaataagatattcactgattctagccatgtggataatcaaagtagagtataaagtcttaaataggaaatttttatttgttttgcaaattaaatatatctaatacctcttttaagatgcattctaaaattagagttattaaatactggtctcaaaaatcgaaatgcatatgagacagattgtaataacccgatcataagaaaatctaactgttgttataatcgatttgaacaatttaaaattagcgaatgaccaacatgaccatgatactgctgattaatatattattatagcagcaaatatatacatgtccggtttatatctttgactacaaaaatatctttcagttatagagtagtcttggctataaaagtataattttactgaaaaaatattgtaatgaagaaagatttgattccaatttatggattgtaggcgaagtctgtaagtgattttgtgtaaagccaaacttcattagatgaggggaaattacattgaataatcatgtaacgcaacacatcagttatacattttacctaaaatttaataaatattttattagacaatctaattttttattgattcataattaacatcaccatattgaatattaattataagcatttatcattttattattaaataaaacaaccaccgattgttagccggaggttgtctgttgtggcataattgtactatttagtttttcttctttagtagagtaattcctgctaaagagattgttcctaacattgcgaaagtagcaacaagcgcattatcacccgttttaacagaagtattatctttagatggtttttctgttggtgcaatagtatcaacatctgctttttcagttgctctaactgttacttttactggattagaaaagtctactttagtataaataatttcatattctccagtatgagtatcaattaccatatttgggtttacccatccccatccttcaggtaatgcaattgattctaatttattaccaataacaccttctaaatccatatcactaggtaatagtggtttttcaactactgttagctttgctgttttacgtactgatggtttactatcatgcattgcggaataatgaatattgtattcacctggtgccagtttagcaattttttctttactagctacgccatctattaagcattctaccttagtttgattttgatcattgctttgagagttatcgtttaagtcagggtttgtagtaaacatatgttcattatctattgagtaatcaattgtatactctgataagtctactaattcactgcctgctgttaatgttgcttcatttaataaatctggtacaacaccttctaccattgataaatcttttacattgagagctgcagtattagcatagtatttttctgccgctgctttttgctcttgattttgtgcatagtatgcatattcaactttaaatgtttgtcctgctaagtttgaacctgcatctcctggccagtttccaccagtagcaaagtttaattgaatatattgagggcggtctaatgctgctttggcagcaggatcatcactataatcaacacttcttacaatttgatcatcaatataccattccattttaccttcagaccagttaataccaaatacatggtacgtttcaccatcgatcacaacacctggtgtagtaatttttgaccctttgccgttccctgcatatttaccattatctgctcccggtgtatatcctggtttattggtatcgctgtaatgtaacgtttcataaacaaaattaggatcaccgatcgattccatgatatcaatttctcctgataaaggccaaccatctccttggtcaccgttaatagatccatctaacgtaaaatcggaccctaatgtccagaatgctgggaaagttgcttgtccttctggtaattttgctaatacttcaatacgcccaaataaaaaatcttgtttgccatgtgttctaacgcttccagaattataaataacttgacgatctccacgtggatttttatattgtgactccttagcacgatctgtcacctctaagacaagttttccgtcatcaacatgtacgttttctttatctttagtatagtgttgttgttcaacaccacgaatacaccctaattcataaccccatttagagttatctaatccattgttatcaatagcacctgttccatcgaactcatctttccaaattacttcatatttttcatcatttggagtagtctcagtacctatttgactcaatgttacatcgtcaatatagatttgtgatttatatgtagcattctcagttgattctgtccatttaataaaagctaatgctacttcactattttctccactattaaatgtaaatgttaaatcttgatattgccaagcttcattaaatgtaattgcttgttctatagcaggatttaaattctctacatttggtgttttaatagcaacaattgcttgtgcagcagcatcagcacttaaaactttggctgttactttatattctttgttcttctctaatgataatgtttgatatactgatgcatttttactgaatgatggtaataacccgcaaactttactgttatgagccgcacctgggtaatcagtaatttgaccatcacctgttgtactccagtattgacctttattagtttcaaatccaccattcttaattaaatttgttccgggtttagttctttcaagttctaacatttcatactctgtttctaaacctgtagtatcaagatttttagctacggctgaaaacatatttattcctgaaagacttagagccgaggttagtgctaatgcacttttaaaaaactttgacttcatatataatctcccttttatagaatgttgtaatagttattcacctattatgccactgaaatcgttttcaaataactagtaccaatataatatataaaatttagtaaaatatttcaatatatttctcaatatttagtaaataattatatagttttatatataattttttactatctggataaacactatactttcaaataaagtaggaaaattatgattatggttcgtagttcatctctcactactgttatgaaactaacaatactaaaataaaagaatcctagtaaatatatacacttatataacaccgttatagctttgattgagaaccttaattataattgtactgattataaaatctttataattaaagccttgatcatcatactaattaccctaatatcaaataacttgtttataaaaaaagggaaagaaaatcgagaatgtccgcataaatactatatctatcagaaaaacggatagaagaacagaaagtaacttgagatcgtaatgtatccaatataatctgcatcattcaaaacgttatttgctccattctcttgattgctggaactatcttcattataatactcagtatttctttgagacggttaattctctgattctgtatcttttgaataagccctaataaaataattacaataactaagcattttaagagcaatctattttttcaattaatcttcctctaacttttttaatccaatacttaaggctggctgtgatatgtgaagctgttgtgcataatagcaataaattgttcaagttgtgataactccataattttctcctccaatttataaataaaacttatagccctataaaaatgttatattatataattattattttatcttgtgaaataatacatgtaaagatttgagtatcctttcttaaacttaaatcaataaaaatatattatagttaaggagaaaattatgcaaaaaagagaaattggtcatttattagtatcacaaattggtatggaatgcatgggggtttcccatggatatggtcaagtgccaagtgaaaaatatgcaattgaagcaataagaaatgcatatcaagaaggttgtactttttttgataccgctgaaacttatggtaaagaaatgtttgaagcagggcataacgaacgtcttgtaggaaaagcagttgagccttttagaaaagatataactcttgcaacaaaattatatctaaatacccaagaagttgaaaataatggattagagaaagttattcgagagcacttaaaaaaatcaatgaaaaatttaaaaacagattatatcgatctttattatttacatagaataaatcgcgatattcctattgaagatgttgcattagtgatgggaaagttaattcaagaaaagcaaattagaggatggggcctttcacaagttacaaaagaaacgatacaaaaagcccatgaactcacaccagttacagcagtacaaaatttatattcattattagaaagagactgtgaagacgatgtttttccatattgtctagataatcagattggtgttgtcgccttctctccaattgcaagtggactactatcaggaaaagtaacttcagaaacaaaatttgagggtgatgatgtaagaaagtttcttccacagcttacacaagaaaacattgttaaaaatcaacctattatagatatacttcatcagtttgcaaaagagaaagaagcaacaccagcacaaatttcattagcatggatgttgcataaatatcctaatgttgtacctattcatggttcaaaaaacaaagatagaatcatagaaaatctacaggcctcttctataactttgagcaacgaagaatttaaaaaactagaaaaagcattagctcaacatcaagtctttggacatagaggacataatgaatctgaaaattcggatttttcaaaaaaatggaaaaataaataaaagatattaatagtgagagtttacaaaaaagtctttgcgttttaattaataatcgcagcttgcttaatttaaaaacgcaatattttaccacaataaaactttcactgttttttatttcactgtgacatgatcagctgtctttaatagttacataagttttatagttaagataaaactcagcttttatcaatttataactgctgaacaaagcgcattgctgcaatcacaatatctatcacatgcctaattgcatatttattatattttgctttacacgaaggaactataagcttatttttagaaaactcaatatcacagttgcaagtaattagccaagtattaacttctgcatgaactaaacgtgaaatgattcttttgttcagctgaaaaatagtcccattagtacttaaaataatcaaaagatgctcttctttaaactgatatgattttatgaaatctgcatcacaaattacaactggaatatatagagtacttaattctacttgaataacattacagagagaacgattatctccttgagcatatagataaacctttttacttcttaaaatatcgttaatcagacgattaagatgtgaataattaatcttctcccctacatatgtaattgtttttgacatagactgagcaaacatttttgtattttgaggaagatcacattcttttgaaaagaatgacggtttatcttgaaaagaatgtatataatcaatacaagcgtctttaaactctaaataagaagtaaagccaagatttttagcacattttgaaatctgtcctttagaggtatggcaagcttttgcgacctcttcgatagtcatatccgcgatatcatgaatatgggatttggtataagaacaaaacacatacatcgtagtatatgtttcaacatgattaagaacatcatttaatttatcaaccatcataatagccatccccttttttttattatacacgaaaaactcttactcatacatagtaagagttttcagtttaaactactaaccaagatcttctccattagttttgataactttttgataccaatagaaagaatcttttttatatcttttcatgctcccatgaccgtaatcgtcactatcaacataaatatatccatatcgtttactgcgctcagaagtccctgcactgacaatatcaatacatccccatgacgtatacccaataactttaactccttcatctatacaaatcttcatttgctgaatatgttcttttagatatttaatacgataatcatcatggattttcttatctattgtcagagtatcatatgtgcctaagccattttctgaaacaataatagctttatgatagcgatcccatacctcattaatagccacccttagtccaattggatcaatttggaagccccaatctgtaacttctaaattttcattacgaacttttcttggatgaaattcatcaataacttcattttcaggaacaaaagcaatcagcccttcttcattttcaggatgcgcagacgtacataaagaataataatagctaaaagaattaaaatcgactgtgttctctctaagcagcgataagtcttcttccatcatcttcaattcaatattttttttcttcatataagaaagtgcatattcaggatattcaccttttgataataaatctaagaaaaaataatttacacgatttgcccattgagcagccaaaatatcctctggattatttgtctttggataatataaagacatacctaacattgatcctatttgaaaattaggattaatttcccgtgctttttttgttactaacgcactagcaataaattgatgatgcaaagcttgaaaaatagtttctaattcattttgtgatttttcaatgaaaatagcaccgcctgtataaggtaaatgcaaagacatattgatttcattaaaaggtatccaatattttactttatttcgatagcgtttgaaaactgttaccgcataatgaacaaagaattcaatcattttcctattttcccatccattatactttaaagcaagctggagaggggtttcataatgcgacaatgtaactagcggctcaatcccatattttaaacattcatcaaacacattatcataaaaccttaatccctcttcatttggctcttgttcttccccgtttggaaatattcttgtccaattgattgacatacggaagcatctaaatcccatttctgccattaaagcaatatcttctttataatgatgataaaaatcaatcccccatcttttgggataatattcattatcgtgctttccattcattatttctattgcttcttcataagtaacagtttctgtatttttgccacagcttatttctctaggaacaaactttaccatatcggctgtactcaatcccttaccaccttcattatacgctccctctaattgattagcagctgttgcaccaccccataaaaaatcattaggaaatagtctcataacataactcctttctattgattagtctgttgtttattcgccaaggcaacaaatggtaaataaatcaaaacacaaattataaatacaaaacaaactgaaatagcagtctcccacgaacctgaagctgataaaaacgctttaataggctgtggtgttgtccatccaacatctaatgttccaggcaaaacaagtcctgtagaaatcatcaatgcgcctagacccattgaaacaattggacttaagataaacggaattacaaggattggatttaatacgattggcaaaccaaagataataggttcattgatacaaaataatcctggaataagaccaatctttgcagtttttgtataatcagctcttttccatcccttctttcgcgaaagaatcaaaatagcaacaatcaacgctaatgtattacccgtcccaccaatacatccatagttttcaaacaaggcaaaccatgtatatggatacggagagcccgcagttgttcctgcctgtgctgcataagaaatattagcaatattcatagaagcatataaagtaatataaatcggagaaacagtaaaggttccatgaattcctactgaccataagatcattgccataaaaataagaatcataggtgtaaacggtgtagctcctaaagactgaataggggcttgtaaaatcgcataaactaaagcatttaatccttgaggctctatcagcgaaatacaataagcaataacagaggttaaaataatgatgattgcggtaggaatagcaatcataaatgattttgatacttcaggtggaacctgatccggcatcttaatttgaagtttatcgatctttgttaacttactaaaaccatatccaactagtaaccctgtaattatagcaacaaaaattccatttgcccctagataagattccgttaacattccatcaaccttaggtggatataatacaaagaatgaagctaaagcagttaatccagcttttaatccatctacttcatactgttttgccatatttcttgcaattaagaaaacaataaaaacagccatgagattaattgttccgttacttacaggagataaaactgcttgaaaatcatctaaatcaggaattattttaacaagaaattgaccaataaatcctgatgaacttaataaaacaacattaatacaaacaacaattgatcctacaaatgtaagagggaatatttgaacaaaagcatcccgaatagcaataagccctttaatactattaagctttgttgcaaagggcataaaatatctttcaaaaaaactatttaaagcttgcatacttacttcctccttttcaccaagtcattcatttaaaaagagtcatacaaatattgtataaaatggagtgcactatttgatttaaaattacctgatcagttctattataaatcgccttatatcctcccctctctttacttaaattatagataatacaatttttttaatcaaaatagtttccttaaatggaaactattttttgccagtactatctagataggtattaaaaaatcttgatgattcaaaataaagaacatttcaatctttaaatcattaaatataattttcaccagtttaagccgattcatgcatatattcagaaatcaaaaaatagttttcattaattatttttatctcaattaaaatatataaaaaagaagagattttctctcttctaataatagttcaacattttaaaatatgttttattcatcatttcttctactagtgattctttttgaaaccctttattcacataagtctccatttctaaaaacatagatttattttttagattctcaactttcatagaatgtatatcaataccatatttatcaaaaacttcacgaatatctttcaatgcataatcttcataatagatttccatttgtatgttttgattattttgtgtgacctttaaaaagaaccccctatgaaacaatatctgtaatcctatcaaaataattgttgttataattccgatatcatataatcctgcaccaatacacattcctactccagatgttgcccacattccagcagcagttgttaaacctgaaacattaccattctttacaaaaataacgcctgcgcccaaaaaaccaacgccgcttacgatttgggcagctatacgagaaccatctatttcatttatgtctataaaaccatattttgatactaacattattaaagcagaccccaaagcaaggatagcatgtgtacgcacccccgcccccttatttcgactacttcgttcatagccaatcaaacagccgcaaaatgcagcaatcataattcttataacccatattccatgatttactatatagaatttaatatcaaatggcaaaattcccaccacctattcacaatatatttctttcaatcttcttcttttttcgttatcaaaattatattcttgtaataaaaattcatcataacttctatatttaacccgaattgattgaatcattatttcaatcaattctctttgaacatataataagggtctacattcctcccttaatttctcaggaatttgtagctgctgacataattcatcattactttcttttaaataaatattggataacaagtattcttggattgcatcttcttcactcattcctagagcaatcataatcaaaaagccggcaactccagtcctatcttttccagcagtacagtgaaaataaacatagccatcatttcttaataacaattcgaacaagcgatgatacgcaggattattaaaagccatctctttatatcctgctttgatataagacattagatagttgtatttttctttagtcatctctccttgcagcatagtaccaaaatcaaaaccatattgatcatgcgattgcattttaagagcactgatacgttcatataaaatattttcatgctgcttatccggtgctaagcttgcttcagcttcatctctaaaatcaagaatatattttatttttaaatgatcaacaaaatgattttgttcttttatagttaatttatctaaagcaccacccctaaaaatcatgtagggttttattacaaaaccatcttgagagctatatcccttaatatctctaaaatttttaatattaactattcgcatcttatctacccatttcctctttcaattcatcaaattgctctttagttaatccaaaatcaccaattgcagttaaatggatattatggaaatcactgccaccacttcttataagatgaaatctatttgcaagttcctgtgttaaagaataatcttcagattccatactaggatgtgatatttcaattccctgtaagccatagctgacatatttttcaatttcatcataatttttatattcacaaggatgggcaataatagcaattcctccatcctcacgaattgcctttatcccctctttaatatcgatatatcccattttagagtctacatctagcgaagtctcgctcataaacaattctcgatacttattaatatcattatactcaggatacttatgaacaatcgccaagaataaatgcattttgaagacaatattatacggagcgtattctttagcgtcttcgtaagtaatatttaagcccttttgatttaatattttaataagttcatgatgatactcatccctacattgtaaagtcttttgacatagtttttcaacatgatacggatggttatttaacgccaaaccaacaacatgcacctttttgtgtacatcgtaatcataacagctcatttcaaccccacgaattgtttctaaaccattttgccggcataccttttgcacttctttgaaatgaaaaacagtatcatgatcagtaattgcaatcactttaattcctttttccttagctaatttgatcgtttcttcaatagaatgaataccatcactataagcagtgtgaacatgtaaatctgcatacaccatattatcacatccttaaataatagttaaaactggatcagtttttgttacttttttcaattttgttggaataacttctaaataatcattagagtttgttacaacaaccatagttgtatagtctaagcccgcttctttaatcatttttaagtcaaattctaataacaatgaccccgcttttacatactcacctttttcaacatattgaataaatggttttccttctaatttaacggtatcaattccaacatgaattagaatttcagagccattttcagttgttaagccaattgcatgttttgtttcaaaagttgcacttataatcccattagcaggagcatagatttttccttctacaggaataatagcaacacccttccctaaaacttcttttgaaaacatttcatcgttaacttcgtttaatggaacaatcttccctttaacaggacaattcacttgatttaatttattatcatcgtgttttacttcactttctttcggatcatcaaaaccaataactaaagttgcaataaacgttacaacagctgaaataatcatagtaataatagcattcataagattattagggttgttcccccctacccacattggtaaattaataatgctaggagtcatgaaagcaaatgcttttaatccacaaaaaccagcatataatcctccagtaaaacttccaatcataactgcatacataggctttttcaaacgaattgacacaccatagatacatggctctgtaattcctgcaaagaaagcagtaaatccggcagataagcaggtattcctaaaatctctattttttgttttaaccgcacaagcaaaagcagcagcaccttgcgccatgttcgctgttaaagttaaagttcttgaaaatgggtcatatcctgattgtgataaaatctgaattcctgcaattgctagagtagcatgcatacccgttgcaaccatccatggataaataatacacataattgcaatagcaaacattccaaatgtatcatagcaccataacaatgcattacccaaataaattgaaataatccccatagctggcgctaatacaacaaatgctaacggtgtcataatcagcaatgtaaataacggtgttaacatccctctaatcaattctggcaatactttattcaatccaaattctactttgctcataacaaaaacaattaaaatagctggaattaaagttgatgtatacggcattccatataaaggtaagaaaccaaacatatctccaataaattttggatcagtcgctgaaacaataccactccattgtggatgaaccagcgcacagccaagtaaagctgccatatacatattacatttaaaatgctttgcagctgccattgcggtaaataccggcaagaaagtaaagccagcatcaaatacaaaattaaatacataataagtcattgatgtttcggcatttgcccatcccatcattgatacaaataataaaatacatttccccagccctgttcctactaaaataggaataattggaccgacgcagccaataattgcagaaaaaatagaattaaaaattccttttttttcttttttgtttccaaaattttcatcttctttaatatttgcaatctggcatacatcaagatacacatcatgaacatgtgtaccaataacaacctgatattgaccgcctttcttgattaatgacaaaactccatcaattgcttcaattttttgatcatttgcttttgattcatcctttaaagtaaatctcaaacgcgtcatacaatgctgcaaagttacaatattattactccctcctacagcttcaataatgttttttgaaagtttttcatatttcattctcttttcctccattcttttgaaaacttcaaaatgtgaaggtttggccaacttaatgttaccatccaacaaatatctatttgcaaattattttttagaaataatttttgcaacatgaatcgtaagatataaaacttcctcatcatttaattcataatgataagtcttttcaatatgcgattgtatttttgaagtacaaagatatgactcaacatatttttccttcataatttcaagcaagtcattatttaaggttatatcttccacttgctttattttattaaaaacacgtaatccaaaaaattttaaatgtgttacaaatctatgataagataaagaatcttcatccaactctaatttaaaataatcttttacaataccaataatctctaatatgaaatttgtcatttcataaatatcactgatatttctaccaacctcactactcactatatgtaatgctaaaaatgccgcttcatcctcttccatgtttattccatatttttctttaataagttctaaagttaataaacctaactcaaattctttaggatagaaattcttaatttcaaataacatatgattttttaaataaacgccttctttataccgctctatgcttgtatgaatatgatctgttaaactgatataaagagaatcatcgacttctaagtctacttttgcttctttgataacacaatcagatatctccatatattcgagaggaatatcctttaacatattaatcatttttctttgacttggttttaaacttacttcaaaagttttattgatcttattcatatcaatattatcaccggcttgttttccataagccaagcctttccccataacaataatttcctccatttgatagttagttgtaataacaacattattatttaaaattttctttataatcatattcattcacccctgtataaatataaaaaacctgccacagaaaaatatctgtaaacaggtttagtgttgcctcatatgtgcaataactatccataaattacatatttatattatcattcctcgcaaaatttgtcaacgctttcaaaataaaggatttgatttaaaacaaccaaaaattctattaaaaattaaatactgatattaaattattttcaacctaaataatgattaggtcttctatagccatacctagataaccaaaataaatctattcaatgtaattataattgattatatatctaataatcacaaatcttaaaaataatactaaataaggttagataagcacaccctatcattataacttagtattagggttatattttttgaggcttcttacatcattataaattatttgtctaaaaattacgaatacataatttttccagtaactcaccaatataatacagtgatacatagccagtatttattgaccactctactccgtaacgataaaaaatatctaccttgtcagcaacctctttattataatcctggcttatataaataaccttagccccaacttcttttgcattttctaacgcatcatggtagtgaaaaaaaccgtcacatacattaatgataacaacaactgaattttcattaaaaaaatagctcctaaccgtcttcgtttcactgactttaaacagatatgcgcacttccccgaagtcaataatttgatttgcaacaaaaggaattcatcaagatcatgctcatcacctagaaaagtaatatcctcgctttccttaaataactgaacaatttttaaaagcgttgctaaatcaagattctcttttgttgcaacaagattatcaagacactgttgaaaaagatattcactgatttcttcattacttttaaaaagaatattctgtgataaaaatactttcaaattataatctaagagtgttgtttgagttgataatagggttctaaattgctgataattttcaaaactatatttttttataagtcttgaaatacttgccttagatacattcgcctctcgagctaattcattaatagaagggaatgtttttttccaatatacttaaatacattttgaataatattataatcattactattaacagcttcgcagttacatctttgaataaaggttaagaaactttctagtatttcctcatccatttttatcagctcctttccctatattataacatcttgataatataaaagaatatgagtcttcaaaatattagactcatatcaattaaaatactttttctttattacaactattgctcccccacttaacaaaataaatagacaataaactccaaacagcgaaggatcatccgtcttaggtgccagcacagcagtatgtgatgattgtttagttatctgatcattctctactatatctagaacattagtatcagcagtaatattaaacattgtagctgcttgtccctcattggcgattattactaatatatgttctccaattgttaatgttgaaataagttcttttggtaaaataatggttattaaatcaccagaaacagtatactttgatctatcaatttcttgatcatcaattatgagcattttgaataatgacgatggtatgtcagtctttattttaagttcttctccctgtttaatatttttattagctccatctgttatacaatattcaatattttcttgattccataggatatctttagcaaatgttgtaaaagctccgcgccacgtattccagtcatgtcccccattttgtatttcaaaagtataatcaatattttcagcatctaatttaggtaacataaaatctaagatagaggccttaaaaaaagaattaatcaacccaaaatcaactgttcctgccgaaagatagattttctttgtctgtaattttgaaataagttcgtctgtaaatacttcatcatcaatttgaacagctgctgaaataataccaaaatatccaaaactatcaggtgcaatttccattactgtacttgccgcaacaccaccagctgacaatccagcataagctcgatccttaggatcagttgaaaccttataattcttttcaataaaaggaattacattattaacaacatcttgagccaatatgacattcgatttaatatcaaatcctgtcccgctaaaatgcgaattatttaatgtcacgattatactatcagctagttctccttcagcaattagattatcaacaatattacctgctgatcctaattgacaccattcagtttcgttgcccccattaccatgtgctaaataaatcgttttatagttattccctaaactataaccattcggtaaataaatcccaagacaattttcagttccatcataagcgatgtatgtatcgtattgataagaacccatattatcatttcttggataaatataagattgacccgctaatgcatctgaactatttccaacataaaaataggaccaagtagcatcatgattattaatttcattcttttttgaaggattaacaggatcctgcacaactactgcagatccatcactataagttacaaaatatccataaaaatattctgttgctggtaatggtaaggtgacagaatataaattttcatcttttaccatatcatagagaatatagtttccattataattaaactcagttcgttcagtatttccgcatcctccagtaggatacattccctgctcatattcataagccgaataccgccttattccatcattgcttgccccgttttcttgataccagggagcttcagaactcttaataaattggaagcctccttgtaattggatattttcaacattttcccctaattttgtactgtcaacaacaaaggttacttggtactttgcctcactaagaccggttgtgttatcagtaatagttattccctcattaacagcatgtacattactcattgagtaatacacccaaagataacaatagtgtaaaacaaatttctatctgcaaaatccatctttttacttgtctcatatttcttcctcctaaaccaagaataacaaaccaaccactttctgtatacgtttacaaacgaaacttagttacagaaaatgaaactaatattcttgcataaccgcaaatcatcagaaattataactatataaaataaagatcacttccttattgtaaggaagatactttcttgttaatatattgattatgtagttttcaacaagttattaattcaaattaattctgaaaaggaggtttcaatgaactactttgagtatagctattccactagcagcactacaactatttttatatttattttcatcctcttaaatataattgcacgatggcgtttattcactaaagctagacgttggagaatcagtgcttttattccaatttatagtgatattgcattatgtcgaattgtaaaactttcaccactttggcttctatttcttttaattccccttattaatatgtactttattatcttttatcacattgttattagttttaaactttcttttgcatttggaaaaggcataatgttcggacttggcttgttagttttcaacccactgttcattttaatattagggtttgggaattgtgaatatcgttactaataaaaatagatatagttatcatttgtaaacacaaaaattaatagaactatcaacttaaataaatatcaaaattaatttgcatattttttcaaaaaaatgtaaagagactctaaaaataatcaacttttttaaaataaaaaagaaattctacgaattccttttaactgcgatacatcaaatacatttgattaatttcttcttttatcttatctcttaattccaacggtttaaaaacctcaacatgattagctaattgtaaaaagccactgactaactttttatcatcaggaacccgttcaattgaaacatttacaaatcgacggaattgttcaactgtgaatgtacatcccttaaatcgttgatacaaagcttcaaaaatattctcatttcctaaatacacacgtaattcaatgttgatcaaattatcttttccaatatcaagcggatcattagataaccagattcgctccttaaaacactcagtctttgcttggatatatttaggggtacgagttattttcaattgatcaatgcgatcaattcgataatatgccaattcaaaatcttcactactatttattaggtaaccaactaaatatacttgatcattttttatatcaatattagttggatataataaaattgttttatgactaggcctatctataactttgttttcaacaacactatattccaattctttaaatgatacacaagcaaatgtatttatagccttaataatttgctctaaatacactgtaatacaattatcttcataagttgaattgatattatctaacaaatgataatgatttattttatacaaagaactatctgataatactttttctaataattttgaatcattttgactttctaaatgtaatcctcgacctaataaccttgtcaataaaattaattgagcatcagtataatatgtcttttcaacgtacgcaccttttttttgttttgttgcataattaatactaccactttcattgcatataaaaggggtaagcaactcatcttgacaatcttttatcaaattattataagattttattgattcaatatctgctttaatcgtattgctagaaatcgtcgttcctaacccaccaattcttttaattagttcatcacgtgataaagcatgatcttcgtctgttaatctttttaataaatattgcgttagcaatatgcgagttccattactaatatctcccattcctcaaccctccatactctatattttactttatcttccaaaatatgtaaaattagtaaatataataaaaaccaattatttggtgtataaaattgtatacataaaattaatttcactatccggcaaaaaagtatatgtttatgacaaatttatgacaataaaaaagactaatttattaattagtcttgatattttctaataaaactatcaattttactccaataaacttgaccaccaattttttcacattgagcatgtccggcacccttgattaccaatttttccttaggacaattagcactttgatataattgattgagcattttaaaagggacaaaacgatccttatcgccatgaataaataatgttggcgtagttgattttttcacttgttcgattgcttcagctttgccaaatgaataaccggctcgaatctgagtcacaatatttgcaatatctaaaaatggtcgacttggcaaattatacatttcttttagctgataggaaaacatctcccatgtactagtgaatccacaatcttcaatagcagcaataacattgacaggcaatttttcccctgttacattcattactgtagccgctcccatagatactccatacaggataattttaacttttgaatcattatcaattaaatatttgatccagttaattatgtctaaacgatcgagccagcccattgcaatatagtcaccttcactctgcccatgacctcgaagatcaggaagcaaaagattgtaaccttgctcataaaaatgtttagcactcgcatgcatcaatttaccttcagatgtatatccatggacaataatcacataatcatgcccgtaattcaaaaattgataagcatgcagttttaatccatcatcactgtctaagaatacatcctgataatgaatagtatcaaaaaaattgctactatctcccttcttatttatatcggttctatctttatcgggtatttgattatttgttgagggattagtaaatatcgcatctttattagcctgtttatttaatgccaaattatataaataattaccagcataaaataaactaccaattccagctgccaacatagttaaactaccagttaatgcaattttcgtcttttttcccattactagaacagtgttccttgtttaccccaatttggatattcatcaaacgaaacataaacatcattaatttcaatatttgttgtttctttgatcatttttactaactcttcagtaaatttctttttagcatcaaaatcaattgtattatataatttaaccgcaatcatcatgcaaggaatgtcatcaccgcggaaatacataatttgattatcctctaaatgtaacattaaattttcttcttttttaccaggtaagattgtaatcagctccccagttcttttagcaatttcattttcttgcctaagtgttaatttatgatttgttgtaaatgaaataaatggcatatatttttcctccttatttttattaaggatattttaacactttttatagccaatgttaacaaattattagctatcttaatttgaagttaataaaatttattaaagcgtttacataaaggatttgatttctttttttgattatgttaaaatataagagcaaaagtagcaatataattttcaaagtatcacaagtattagaagattgtattacctttatgtaccgccgcaatccgatatttgtgatttagagttacatagagtatttcctttttgcacatctttcaaggaggtaccattaatgagtacaggtaaagtaaaatggtttaatcaagaaaaagggtttggatttattacaaatgatgaagatggaaaagatatcttcgttcatttctcagcaatcaacgctgaaggattcaaaactttagaagaaggtcaagttgttgaattcgatatcaacgaatctgatcgtggaccacaagctcaaaacgtaactgttaaagcttaataaccagaagaaacccggttaatcgggtttcttttttattcaattattccataatgaagcagagctttataaattcctccatcataaatatcacttgtaatatattcactagcttcttttgccacatcaacaccatttcccattgcaattggatgcccaactactttgaacatacacacatcattaaaaccatcaccaaaagcatagctattatcacgttctatttttaaaatcgtcaatagttttttaattccaattcctttatcataaccaataattgttgcatcagcagaattatgaccaaagtgctcatttaaaactactgtatcttgtaaataggaaacaatcttttggtaatgttcttgatcattaaaatgaacatcaaacatgtgggcatcgatctcctctgttttaaaatcttcaataaaatatggatgttcgtaatctgtttgcatatcagctaacttattaaaatcaattccatgagcatagccaagattaacgccattaaaattatatccacattctaatttatcaaaactatccacaaaataactaacctgtttcctagtcaatggttcatccaataatacctcttctttatacacgatatatcgaccatttgcacaaataaaaccatcaacatatttttcaaaatgatattttgcgtaaatatatggtctaccggtgcaaataaaaacgtaatgccctagattttgtaactttcttaaagcttcttttgtatcttcaggaataatattttttactgctaaagtcccatcaatatcaaaaaagaatatttttttactcataatagttcctccattacattattatacaataaaaataaagtagagttcaatgaactctactccataactcgaattgcatgatatccttcatgaattgctgttaaaatttttcttggtgcttttgcatcaccaatcactgtaacatcatcataaatttcccctaaagcatcttctaattgatcatttggtttaaatccagctgcattgataattgtatcacacacgattgtatactcctgattatcttggagatatgtaactcgattatcttcaattttagtaacagttgcttttgtaattttattaatattattatcttgaagcatttgtctcaacgcctgatcattatttaaacagtggtcacaaccaaataaaatatcttcctgcatttcaataatagttaccgtttccgcattttctttaagataacatgctgcctcacatcctgctagacccccaccaataattactatttgttttcctgcttctttacggtcagtcaaaaattcacttacaaaacctgctttttcaattcccggaattggtggcatcattggtgatgaccctgctgatagaataactttatcgtaatcttttttagcgtctttgagcgtaaactctgtatttaaataaacattcacaccagttttcaagcattgtctttcaagataagtaatcaatttcaagacatcatgcttaaaggtaggcattcctgccgcccaaagtgtaccccctaatcgttcttccttttcatataagtcgacttcatatccacgttttcttgctgtgatagcagcgtacattccacctggaccgcctccaataactagtactgattttttaattccatcaacttttggcagtgcgaattctttttccgcatagcaaagtggatttacagcacaataataatgttttccagaaaaacctgctaataaacattcattacagccaacgcatggtgcaatatccattgtatttccctgctttactttattagcccaatgtggatcagcaagcatttgatgacctaaaacaacataatccaaaactccttgtgctactacttcttgtgctttttttggatcaaataactttccttgccccaatactggcaatgatacattttctttaattgctttaactacatctaattggtgtccttcttcgttgtaaacagttgaaatagctttataccaagcctcataacatcctacatcaacatgtaatgcttcaatccctgcaccctcaagaattttagccatagcaattccttcatcaatttgtctaaatccctcaactttatgaaccggagtaaatttaactaaaattggaaaatccggtcctacatttgttctaatcgcggcaatacattcaagcgtaaaacgcattctattttctaatgaaccgccatattcatcagtacgtgtattccattgttttgaatgaaattgatctaataaatatccgccgtaagcatgtaattccaccgcatctgctcctgccatttttgctaaagaagcaccatatccaaccttttcaacgatatattttatatcttcttttgtaaatggcttacatttcaaatcaggaaaccaaaacgccccacaatcactagctgaatatggtggtgtaaatggatcagtaaattgttgtcttcccaatcctggtgatacttgaacacaaactttagcgccatagttatgacatctttctactaacatattcaaacgctcaacatgatgaaaattactaagttccgtacatggtcgaggttcatatttagtggatacaacatttgcaccagttataattaagccggtacctccctttgccctttcagtaaaataattaattgcatcgatattatatgccccatctgcttcaccagttgttcccatcggtcccatcacgatccgattttttaatttcattttaccgatataacttttttcaaataatttattcataattctcctcctttacttcggtaatatttattttactcaagtaaagtataacataataatcataaatgtaaagggttacatttatgattacattacttgctttttttactagatgatttatacttaattattagaaatgaggaatacgatgacaaagattacaaaagatattattattgaaacagcttaccaactgtttttcaaacatggatataataatgttacaatcaacgatatttgtaaagaatgtaaaatcacaaaaccaactttttatacctatataaaatctaaagacgatattttagcacatttttatgatgacattacagaagcaatcgttgctaatacggctaatataatcatggcagaaaattattggcaacagttattgatctgttttgaaacattaatggaagaatcaataaaactcggctatgacttaagtagtcaaatgtttattatgaatttaaaagaagaccgtggtagttttgattttcgagatcatttgaccaatatcgctattgcaattataaaaaaaggtcaagctaccaaacaaattagaaatcaaaacgatcctgaaatactatatcaagcttcagcatatgcatttacaggttatgaattaatgtggtgcataaaaaaaggtcagtttgactggaaaaaagaattaagaatagcattagaaaacatatatgatgttgcaccagaacttcgaggttaaatatgaaactatataataccataaaaattaacaatcacagctattatatcaatgatgaggatggtgactcttgttatctaataataggaaatacccatgctctattaattgatttaggcctatttaaagaaccacttttaccgacgattaaaaatattactaataaagaattaattatagtatgtactcatggtcactttgatcatattggcacaatcaaagaatttaaagaagaaactatctatttatctcatcgagaccgtgatatttattatgataatgctcatattattaaggaactttctttgattgacttcaaccaaatcaaagatttaaaaaatcatcagcaaattgagcttggtaactttgaaatagaagtccttgctcttcctggtcacaccccgggatcaatgatttttctagaccgtcaaaataagtgtatttacactggtgatgcaattggttccggctgtggtgtttggctacaattattccatagccttgatttaaaaacgtatcataccgctctccagcagactattgactatcttgaaaaacaaggagtagacgatacttggcatttttggggtggacacaatcaacaagaaattcagtcaaaaatttctgcatataataagttagattttgttttaatgaaagatcttgaacaactatgcctaaaattaataaacagtgagattactggtataaaaaactcagctccaacatttgatgacaaccaagcctactacgccagctatggtaaagctgagataatttatcaaaaaaatagtttatagtgaaattttcggatttcactttcttttttcattcgcattagagctattatctatgataaaataattccatatggaggtttaccaatgaaaacattacatggtttagactatagtttaaaaataaaaaatacaattatcaatcacattaatcaagctcagaaaaatccttttataaattattattttattgttgacgatccattatattttgaagaagctttttttaaatatactgatacactttttaatattagaatcattacatacaatgatttgatcaaaaaattattagagcattatcaactatactcttatcaagaactatccaaattagataaaatcctaataacaaaacaacttattgaaaattctaataacttattcaatactaatagtaaaatggatttaatctatgaattgattgatattttcgatcttttctttcttgaaagttttagtaattcagagttagagcagctgccccccctagcgaaacaaaaaattgcaacaattatcggactctaccagcagctaactacttcattacctaataatacatgttacaaatatgaagaactattatttgaacaaattgataattctaatgttgaagatcattatatttttattagtgaacaaattttcaaacaacgtcgctttgaactaataaaaaaaatatcactttataatgatgtaacaattttggttaataatagtagcgattcacgtgatttgaataaaccttttaataaatatcatggtgatcaaaaaaacgtctttgaaaatgataatccttatttgagccatctcaataaatacttattttcattacgatcaccaaagtatgaaaatcatacaccactacatacaattattcagactacaccaaaagctcaaattgaaagtgtagtattaaatatttatcaagatattgtagataatcacacgcactatcacgattatgctatctattaccccaaccaagaatatttaaccttattagttgatactctaaataattttaagattccccataatattaaaaaaagcttaatattcaaagaattggatgcttgtttattatggattagatactgtttaaatcatgataataatgatcttttagatttattggatactaaagttttaagtcgatataatgactttgactatcttgatttgattaagaaaaattatcttgaaaaaggttatattgaagatccctttagcaccctatataactttgaaaaagcgcaatcactagatgattattcatcagtaatgattaattttattaatcaagaaatgcttttttcacaaaatcagacaatgctaataaacttcttcactaatttaacaagtccccagtcctttacacttgccgacttttatagtttagtaaaccaattaaaaccgtctttaaaagaagatatcaaaccatgtaatgatcatttatatttattaaattatcaacaatgttacagcggtatcttagaatgcaaaaaaatctatttggttggtgtcaatgaaactgttgttccaaaacaaaataaagatactggaatattactagatcaagactatcaaattctacaattacctgatttaaatcatcaaattagtgttgatcaaaataatattctaaaagtcttaaacagccaaactgaatttacagcaatatgttttagtaatggaacaattgatggtcaaccgctattaaaatcttctttgtataaccaattaaaacaaatgtttaaaatttcaaatattgatataaataatgactattatcactatagcctgaaaaccaatttatatctacatggtggtaaggatattgaattatcatcactaaatacaatgattaagcactatatacaaactaataaccaaccagataaattaactgttccactattttcgaatcatctctcagcaagtaagctggaaacttacaatggttgcccatacaaatattttaatcaatatggattaaaattatacccttttaaacaaccgctttttcaaataaatgaaattggtacgatcatccattacgtacttgaaaaaactcaagccctctttactgacaatattactgctagtaaagctgaagtcgatgatttagaaacagttattaaccagcatgtcgagcaatatttaaatgaacatggtttaactgagcgcttaaattacggtactaataactatattattaaaacggtcaaacatgatctagttaatactgtaatcgttcttatcaaccaaatgaaagcatctgatttttatattgttggtagtgaagttgatatctatcggaattatcctgattttaaatttagcggtatagttgatcgagtagatcaatataatcaatatttaaagattattgattataagtcaagtaacaaagaccttgacctttctttggcaattcaaggttttaatattcaaatgctcttatatttagatactttaacaaaacaaaaaaaacttgataaaggtgctttgttatactttaatactaaaaaaagaatccttactagttctttaaaaatcaatgaatctgaacttagtgaaaactttttcaaattatatcgaatgaatggttatgttaatagtgaagtagtcgaagaagttgataacaatattgataaagattcagcaatcattaaagcaaaatttgttaaaaaggatgactgttacaaaggaaatattttaagtagtttctcttttgaacgtttaattgattatgttagtcaacatatcgaaaatttatatcatgaattagcaaacggaaatattggaattaatcctaaaggtagtgatgatgctacagtcttcactaaagttaatccatgtacttactgtaactatcgtagtctatgtaatttcgatgtcttctataatgaatatactttagttgacagtaataatttagaacacttgcttgaggaggataatagcgatgccaattaattctttaaatgatggtcagtatgaagctgtcgtaacccgcggatgttccattcttgtttcagctccagctggttcagggaaaactaaaattcttgttaatcgaatcatggctttaattgaagatgatggttataatgtcgatcaactgcttgtcttaacctttactaatgcagccgctcttgaaatgaaacaacgtcttcaagttgcattagatgaacgtcttcaagaagatatcaataagccattggaacaacatttattaaagcaaaagcaattattacccaaagcttatattactaatttccatggtttttgcagtactcttttgaaacaatatggatatttgatcaaccttaatagtaaatttgatatttgcactgatccttcactcaacaaacaccaaattctcgataactgtattgaaacatgggcagaagatcaaacatttattgattttatcagtacttattttccagaatactattttaacagctttaagaacgctattttcaaatttgaaaatttaagcaatactatttatgactttgataattatattgatacagtcaaaaaagatatttattatcacattattaacaacgatgatgatgctataaacaattggcctatcagtaataaaattatcgaactattacatcaacaagctactatgggattgaataaggtttatgaattagctagttatgccagttcccataatttgtctttttactatcaaaatccctttggtgataagcctaagaaagcagatttaccaagcccatatgattgtcatttaaaatattacttcgatgtcatcaaggcaatagaaagtaaaaacatgacgaatatcattaccgctagtaaagctagtttgatgaaaagttatgatagtagaggtttatttaatgaggataatgaactttataaaaaagaatataatcgtcttaaaaataatatcatcaaattttatcgcgataaatttaatgatatcgtatacgatgattttgatgagtttaaattaactttatcaacctctttagagcctttagaaaaattaattacttatttaaaacagtttaaacaggcctaccaagattataagctagctcataatcttttagatttcaatgatcttgaagctaatgcattagaattactagaacccaaatacggaattgttacacttctataccaacaattaaaagagatcatgatcgatgaataccaagatactaatcagattcaagaaactctaattaataaaattgcagatcttcatgaacccaagatcaatcgctttatggttggagatatgaaacaatcgatttatcgttttagagaggctgacccggaaatttttaatgagaaatatcttacttttaatctactacctaaaactaaacgtattgacttaaaatttaattaccgatcaaataaaattgtccttgacagtgtcaattatatttttaatcaaatcatggataaggatattggcggtcttgattattacttagatgaaagtgccaaattgaattatgattttttacgtaaagaaggtgcaaaagaattagaagatttgccagaagtcaccgccaaagcatcacaacgtcttgatgaagaagcacgctttactagcgaagtcatcctatcatatcaaactggtactataagcaatgatgctgaattagaagcaaaaattgttgctaaaaaaattcaggatatgattggtcacttagaattagataattttaacggcacaaaaagactggcagattataaagatattgttgttttaatgcgtagtactcgcagctttatagcttttaaaaagatatttaataaatttaatattcctagtcatattgttttatctcaaggttttttacaagctccagaaataattaatctcgttaatgttttaaaagcttttaataatcgccttgatgacatcgcctttacaagtttactaaagggcaattatgtaataagtcattttagtgagaattttttagcgcaaattaaaattgatgaaactatctcaatgtttgataattgtattaattatcttgaaaaaaaattagataattatgaagctttagaaacatttataaattattatcaagatatgcgaaactattttaatagtcattctattaaagaaagtttgatgaaattccttgaggatagtaattatttacctttcttagcttcattagtcaatggtcctcaacgagttgcaaatattgaattaatgattcaaaagttagatgaaatgcatgatgattctttaaatacaataactactaaatttgatgatatgatcaataatggagtcaatctctctcccgcaatggtttcaagtaatgatgataatgttgtttcttttatgactatccataaatctaaaggattggagtttccaattgtttttgtttctaatatgcaaaataaatttaatcagcaagatgcccgagaacgaatcattagtgataaaaaattaggaattgcgatcaaaccgcgagtaaaatgtgatttagaaccctatcaagacgttattgttgaatacgaaaataaatatcgaaaagtaattgcaacagcacagactagtgaagcaatcaacgaagaaatgcgaattttttatgttgcattgactagagcttcacaaaaactaattatgactggcttaattaaggaaccccaagatcttatcaaatggcaaaaatatgtaattaataatagtgaagattcaatgataaatccacgttgtaaagataaagtaattctttatcataatgcacgtaagcaaaatagctatttagattggttaggaatttctttaatgagtcacagtaatattattaatcaaggtctaaaaaaagaactcctagaccatgatcaaacagatgatcttgttaatgaaataaaacaaaattttcaaactattttgattcatcaaaataagcatttaattcaagaaaatactaaacatagtaaattttctatcaagattcttagtcatcatgatgttgaagaacaaattatcgtttcaaataaaagtgatactattcttgacttaagcagctatcatcgatatagtaattttgaatatccatacccaactaacctagaaaaatccattgctgtaactcgtaaaattgaagatggcgatagaagttttaaggatataagttatgagcttgatgattccccagttgatgctggaacacgtggaacaattattcatagtgtgcttgaacatcttgatattgacgttcatttagatttatcagataacttaaataaactcaaacaagcaaacctttatgacaatgaagcctggcaattaattgataaatatcaacaacatcttgaaaactttattactagcccagtttatcagttaatggttaatgctgactatctttatcgtgaaaaagaattttctatgcttgaaaacggacaaattattcatggaatttttgatgttgtctgtattaaagataatcaaataacaattatcgattataagactgataatttgaataaaaacactagtaaagaaatactgatttctttacataagccgcaaatggattattacaaaaaaatattagctcgtgttttcccacaagctaatatccaggcaatcgtttattatctatatattaataaatatgtaactatttaaaaatgggttatccgtaacccatttttatttcacaacaatatctttaatattctttaagatgattcgcgtcataccgccctcatccatttccttgacgatatctacaccttcaagataatcctcaacatttaattcaataattcgatcatcatctaaaactaatttacaacgtgacatccgatctagcgatactggcacgttgacaatttcatcatcttcttcaattcccagatcgcgcataattaattcaacctcttcagttgcattatagtcgtttcccataacttttttagccaattccatcggttttaccggacgatgatccattactaaatcaacaagttctttttttactaatggtaggggatccccttcaacaacattatattcactgtcaactttctttacaactttattaacaatactcattttttgtttatctgttaattttggttcacctttaatatattgttcattcaagtaatatcctggtttcccatcaatcatataacgtttttcaataatcgacaaaatattatcttcaacattgataataattgcttcttcaacagctgttgttttatttggtaaaatttgttgattaataaatctaatactacgtataccatcattttcttcaattaaactcattggcatagttttatagtttaacttaataattaaaacaaatttcttaccatctacttttaattctacaaacattaaattagcatttggcatttcttcaatttttgtacataaatcaaataaatcttgcgttattttaatcgattcttctttaaacgcctcattactttcaatcatttttttaccagcttgtaataagtgatgctcactaccggttaccaattctttaattccagaattttctaaacatttttcaatttttttatcataatactcagttgttccttcagttaaattaataaatgtatctgagtaaataattttactatgttccaaatccaacatatgaatcaaaatcttatcaattataattgtattattcattctttcatcaccacggttaagtatatcatattttgttgaaatacgatataataatcttggtgattaaaatgaaaattattatcgcaccggcaaaggtgatgaaaacaaaacaagtaaatattgaaactacagatatcttatttaaagacaagactacacagctacataattatttaatgaaatttaatcttgatcaactccatgacataatgaaaatatcttttaaaatggcggatactgtctatagttatttccacaatgaatatactgcggttcctgcactatactgctatcaaggtactgtttttaaacagcttagtttgaaagactatgatgcagacgattttgtatacttagaacagtatttaaatattttatcggcttattatggcatcttgaaatacaatagtgcaataaccccatatcgtttagatatgattatgaagattgattttaatttatatcaattttggcaagatgaaattgataattattttaaaaatgaagactatattatttccctagcctctaaagaatttactaagatgctatcacatccccatatcataaacattgactttgttgaagataaagcaggtaaaatggtacgcaattcaatgtatgtcaaacaagctcggggaaaaatgcttgatttaatggttaaaaataagattagtgatcttgatagcttaaaacgtctaacgtttgatggctatatatatcatgaagaattatcaacaaacgataattatgtttacattagaaatggaaaacaaacatataaaaagctataataaaaatagatggcgtgccatctatttttatttatttaaatattcttctaagaaatttatcattctttccatttcttcatctgtcccgatactaattcttaagtattgatcaattcgcttagtattccaatgacgaacgattattcctacttgccgcaatgctgtaaataattcttggccttcaacatcaggatgttttacaaaaacaaaatttgcataactgtcaggtacaataaaacctaattcttttaatcttgttttagtcatttctcttgttttaattactttagcacactttgcttttgtatcttgatcgtcaaggatactcgctaaacaaatttgttgtgcgacataatcaactggataagaattaaatgaattcttaacatcatacaaatgtctgattgcctctttacttcctaaagctattcctagtctaattccagctaaagaacgtgatttagaatatgtttgtgttacaactagattatcatatttatcaattaaagagacacaactagttccaccaaaatcaatatacgcttcatcaatgactacaatactgtcagggttattttttaatattgtttctataaaatctaaatcaactaacaaaccagttggtgcattaggatttggaaaaataattccactattaggctgcataaaatcattaagattaattttgaaatcacggtctaatttaaccagtttatatgccatttgatataattcacaatataccggataaaaagaatatgtaatatccgggaataaaattggttcctttccattaaagaacgttaaaaaaatcaacgcaagtacctcatcagaaccattccccaaaaatacttgttcttcttcaagtccataataattagctaattctttacgtaaatcaacagcatcactgtttggatataaccttaaacgatcaatatccaaagatgttaatacttccttaattttaggactaggtccataaggattctcatttgtatttaacttgatcatattcacaattttaggctgttcccctgctacatatggttcaacctcgcgcaatttatcttgccaactcatataattcccccttatttaagcatttcatcaatcaactccgataaataatcgacttgtttatcactatgctttttaatcagttcatccgctcgattaaaagtgtaaccatgatccgcgtgctcaaacatactaatatcgttatacgagtccccaatcgcataacttacaacatcttcattaagtaaactaactagattgctaattccagttcctttcgtacatccacttggcgtaatgtctaaataatgcatatttaatgtaccatgcgcttcatctgcataatgttcatctatatatttttgaatctttaaaacttcatcaatctgctggttgtcttgatttatcgctattatatcaaactcctcaacatttggatactcttttataaaatcatgctcattcgttacaatactacgtcctacctcatcataaatatatgtttgacctctcaaataccctaatgtcttttttccatcataaaaatatatccacatatcatcatatttcaaacaatgttctatgatatcaataccagcttgttttgaaataactcgtttaaataattcttgatcattacgatcaacaatatgagctccattatttaaaactaaatagtcataatataaatctaatttgtttgtactgcgtaatgcttcttcataatttctcccagtattaaaagcaaacaagtgcccagcctggtgaagcttttccactttctctttatccgggggatataataacccatctaaatcaataattgttccgtccatatcacaaaatagtatttttttcataaaatcctccaatatatagccatattataacagtttagactaaatcatcaaagagctgataaagcatttgattacttttatttacttcttgtaacgctgtttcaatatctttcgccacaatttttccatcttgcaggcatacacacttaccgctttgattatcttgaagaagttctatcgctttatttgccatccttgcagctaatatccgatcttccggcaccggtgagccgcctcgttgaatatgtcctaaaacaatcgagcgacctgaaaatcctgtttcttcactgattcgttgtgctagcttttcaacatctaaaattttttcacttgcaattacaattgcatggcgtttattataaacaatttcattcttaatcaactctttgattacatgctcttcatcatagcctgtcttattggtgataacaagttcacttccacaagatatagctgcataaagagctaaattatctgcattgttacccattacttcaactacaaaacaacgatgatgagaacttgaagtatcacgtaatttatttactgcatcaataatattacataatgcagtatgaaaaccaatcgtttcatcagtaccattgatatcattatcaatagttccaggtattccaatacaatttatacctttttttgctaacgcttgtgccccacggtaactgccatcacctcctattataacaagactatctatttcatgttcttttaaattgtttattgctctatcttgaacttcatctaaagtaaactccggtagacgtgatgattctaaaatagtacctccttttgcaagaatttcagaaacatctcgatagcctaagcgtgctattttaccctctactaatcctcgatagccttcatatactccataaacttcaaatccatgttttattcctactctgacaattgctctgattgctccattcattccaggagcatcaccgccagaagttaatactgcgatttttttcattttttcacctcatttaactttctcttctaaccaattttgataaaactctagttgattctttagatgaaaaaagtgttccccattttccatgatttttaaatcacaattaaaatgactggcaaatttctttatatattcatattcacataaattgtcattttcaccatacaaaatcattgtttgactattccattcggtgactgaatgttctttaacatagcaataatagtcataatacaatgtttccccaataggtgtttcaatcattttttgttcttttaatttttcttcatttatttcaaaccaaatcatcatattttcaattaaacgttgcatatcaacaactggtgataaaaataaacactgattaaatttaacacattgataagctaataaactaaaaaatgctcctaagctacaggcccataaacttatcttttcatattttcctttaacatagtcatatatctttaataattcctctgtacaattttgtgcattacacaaagtatcttcatatactcgatccccatgttttggcaaatcaaaactaactatttgatatcctctatttactgctgtctttgctagcatttctataacaatatcttctttattagatttattcccatgaactgcaagaaaaacttttgaactccctgctccccagataactgcagggatattatcaatttttaaatatttctttttcatcttcccaccacttccttatcaataattataacatagtccaaatttaatatttagcttttgcaaaaaataatactacaacagtttatgttgcagccttgtctttggctggtggttggtagcacgaaacctccacagcgggctttcatcacctagttttatgtcgtgcgcagcacagcaaaaaaggaactgattattcagttcctttactattacccactaatttattcatatcagctttagttttatatgtgatttttaatcgataaccatcttcgcttgaaagaattctcattgacacttttgtatcatcttctgattgagtgattcctattccataattaccaatactttcatttcgttcattaaaatcattttctaattgattaaacttctctccagctttattaaaacttacatacatatcatcaccgttaatcaatttaacaatttcttttaacatcggataactttgctcgttgattttcatagcttcaaaatctttaaagccgttaatagtataacctatattaacagcattagttgttcctgataagtcatatgaaaaactaattgacattgtttcatttttaccaatctttaaatcataattcagacttgtataaacattattttgatcagttacataaaaatcataatctttatcaatcgttgttttaccatacttatcagtaattgcagttaaatcattttctaactgcttgatcttcttaacataactatcactattagttactagtttatcaaaatcttttaaactcccaaactgatattctgttacctctttattaatattaacctcacctagtggacctagtgtaattgctttatccggtgtagtaacagtattacttgcagttccgtcacctaaaaaattaccaaataacattgatgaaatcagcggtgagaaaatcaatactaaagctaaaataccgtataaataattaggaaatgtatttgttcttttcatgggttgatagcctttttctaagcgtgtaccacaatgaggacaaactttggcactatcaggaatattttttttacaatgtggacattgtttcatgcaatcacctactcatatatatttgccatccaggtcttaaagtcttccacaaatttttcttttgcctgggctttttttgtatcatcttttatttcataatactcttcacttagataagtatactcgctaattgtttcacctttattaactaattttaaaattggtgtccaattaaaatctaactcctcacgaatatttttataaaaatcaatttctttttcagatgccccctcttgcatggcggcatcacgaaatgcctgaatatttaaataatataaataagtacccttattttcctctaaatacgatgttaaaatcggatgaaactctttacaatctccgcaatcaggacgaccaatatataaaacaaaagtatcatcactagataatttgttttctaattcatcataagtaatttcatgaagacctgataaactattgtctttttttatacgattaatggatgcgtcttggcatccactaatcattaatacacatacaattaaacttaataattttttcattatttaagtaaagattctccatccatttcagctggaatttcaagtcctaataattgtaaaatcgtaggcgctaaatctcctaattttccaccctcttttaattctaaatgagaatttgttacaattaaaggcacttcatttgtagtatgcgctgtaaatgggttattatcttcatctaacaacatttcactattaccgtggtcagcagtaattaacattgttccacctaattcaagaactttattgtatacttcacctacacattcatcaacaacactcacagctttaattgctgctggtataattcctgtatgtccaaccatatcgcagtttgcaaagttaacaataacaacatcgtgaatatctttatctaattcttcaattaatttatcttttacttcatatgctgacatttctggttgtaaatcataagtagctacttttggtgaatttactaacactcgagtagcaccttcaatttccttatcaacaccaccatcaaagaagaaagtaacatgagcatatttttcagtttctgcaattcttaattgtttcataccttttgcagataaataatcaccaagtgtattagttaaacttggtaaagcaaaagcaatcgcaccattaacactatctgcatatttcatcatacaaacaaatgttaaattttttggcacattattaaatgcatggtcatagaatccatcattagtcatcactgttgctaattgaatcgcacggtcaggtctaaagtttgcaaagataactgaatcaccatcagctacttgtccatcaacatttttattatatccaggaattacaaattcatcataagtttctttagcatatgaatctttaacatattgaacaggacattcaaagctttcacctttatgattaacgatagcatcaaacgctaattcaacacgatcaaacctcttatcacgatccattgcgtaatatctaccagatacagttgcaatttcaccaacacctatttcttcaattttatctgctaattctttaacaaaatcagcaccactatcaggagcaacgtcacgaccatctaaaaatgcgtgtacatatactttttctaaaccttcttgtttagctaattttaataaggcatagatatgttcatttgaagaatgcactccaccatttgataataatccccaaatatgtaatttagtattattttctttggcattattaattgcttttaagaattcagcattcttatagaatgttccatcttcaacagctttattgattaaagttaatgattggtaaactgttcttccagctccaatatttaaatgtccaacttcactattacccatttgtccatcaggtaatccgacaggcattccagaagctttaattcttgttgttggataaatcatttctaaatcatctatatttggtgtatttgcaagtttaactgcatttccatcaattctttcacttaatccgtatccatctaaaatacataatacaattggtctttttttcattatctaattcctccattttcatgaaccattataacttgtttaactacaataatcaaacaagaaatacttgaaataatctaaatttaataactttttactaacaaaatctcttcagttaaaatagttttatatttctataatatattgatatataaataatatagttatataattataatataaataataaaggggaaatgctatgaaaaaattattatgtttattactcatttttatgctgtgtggttgtagtattgataaaagagcaactactaaaactgttgatgtcagtccatatctctataaaattagtgacaataataatcactatctttatctattaggaacctgtcatcctggtcgtgatcaaattgataaacttgatataactaccgaaaaagcaatcaaggatagtcaaagtattgttttagaatgttcattagatcaaaatgaaactgctaaatatcaaaattatcttttagaaaacagtttaggtgaactagatttgattaactatattcctaaattaaaagaaaactatcctacactaaaaaaataccgtgttaatgaatttaatgctatggcagtaagttctttagtaacctctgatattctagacgaagtagatggcaataatagcacctccattgatgtttacctttttaatctcaccagaagtaaaaggattccttttgaagaaatggaaggaattgaatttcagatgcaattattttcacaattatctaaagaatcacctcacgcaattttagaatccttaaaagatcgacaacaattaatcaaaagtacaaaattgatccttgacagttattataatcatgatcttgatacattagcgacaatatacagctatcaagaactaccagatagtgaatatcaacaagaatatcaaaattatcaacaattattaataattgaccgtaaccaaactatgcaagctaaaataatagaatatttaaatcaaaataaagtcgttttcatcggcgttggtgtaggtcatgttgttggtgatttaggattaataacatcgttaagcgcagccggttataaagtagaaaaattaggttaaaaaataaaggtctagaatttatctaggcctcattttttctttttctttggcgaacttaaaatgtacattccaataaaacagagaatcaaaggccagtagccttttatatagtatgcaatcgttgatactattccttgaaagtctttagttcgatccatggttaaaatcattcctaaaataattaatacaattcccgcattctttctaaagtccattttaatcacccccattatcatagcaagggcaatcaaatgaatttgtcgattagaggatagaacgtgcaaaccgtaataaattatttaaatctacaggttctttacctttttgtgaatatacataaattctatcatgatcatgatattcaaatttattagaatgaataatactattaatatcccgacgtatgtcctcatcaatatgaataaacaagttttcagacatttttctaagtaaaatgcataaacttgctaacgctaattctaaatcaaaatatgctctaattaaatctttttggataacatgttcatcaaagataccttcttttatttcaactttttcaatatgattcaaaacggcatcgacactatttaactcatcttcaagcatatccaagtaacattcttctttaatttctcttttgttcatctacaagcttatccttttccttaatcatttgtttcaattcttttgcatataacacaaatgacaataacattaatgcactgctagtgataatcattaactgactagcaaaagtatcaggaatgtgatacccaataagaattattacaacaaaataaaaataagctgttgcaattttcccccaccatgaagctccttttatttttaagccataatcatataaatataatccaacaattcctaacattccatctttcaatacaattattattaataacacccaagctaagggatatgtaaataacaaagtaatcgcaattgtaaattgtgttaatttatcagcaatcggatcaattaattttccaaaatctgtaatcatattatattttcttgcaatataaccatctaaacaatcactaatacctgaaagcacaagaataaatgctgcaataatataatgatgttgccattgtgcattaaaatacacaaataaaaatactggtattaataaaattctaaaataacataagcaatttggtatattaaacaactttgttttatctttcatattcatcttctatccctctttttacataattatagttaacttattaaataagtcaatgatagaagatttaaagtatctttttcattgtaacatgcgggcaccactcatcataatacatatctccatcaggtttatatcctaatttttcataaaatttctgagcctgctgttgagctgacaactcagtttcaagacagcctaattctcgagctttgttctctaaagcagtgacaaccttacttcctaatttttgcccacgatattctttgatcgctgcaattcttcctaagatcattgttgtcttatctttaaaatacattcgtccaaccgcaatcggctgctcatccttataaatcaccagatgatacgcagtattgtcaagcttatcaaactccttttcaaagccttgttcttcaacaaatacagcttggcgaattaaagctgcatctttaaaagattttttaccataactaaatttaaaatccaacttagattctatcatcattaataatgtatcaacttctataacttgagcaaatcgattcttccaaatcttttcttctaaatattgctttaacacttttccacttattatatcattgtcaaaagtcgttgtagcatcttttggaacaataactctatatcctaattcaaatgctactttaatactagtatcaatacaatattcactttgcataccaacgataatcagatcttgaattccctgtgattttaaatatgcatctaaatttgtatttttaaatgcactattatattccttttcaaaaattttatcatcttgtctcggagtaatccgtgaatctatttgccaaccatcactatttaaaatcaattcctcatcatgatgacgaacatagacgatttcgagatgttgattatgacataccctgattagttttcgaatatgctcgatcatcttattttcatctactggatactggctcgtcaaagcagtttgaacatcaattattaataaacatcttttacgcatcgttttcctccattgtatcaactaaaaaagtcgtaatcgttgaatacacagtttccttatatttttcattgagaatttcatggcgcatatgctcaaataaaattgaaatcacatgttgatagccttgtttttttaaatgagttacagcattattaaatgctttttcattaatcaagcaaggatcttctttgccagaaataaataagactggtagttttttatttgcttcataatctatatttttatatgtattttgcattaaacttaataaattataaaatccatttacactaaatgtgaaggtacacagcggattattattatattcatcaactacttggctgttactgcaaatccattcatttggcttatcaaagcccttattaaaagcaccaaaagacattttctgtaatagtttactatgatacttatcccccttgaccattgctatcgctttgcataataactttcctaatccggctaatttatttttacttgggctgccacaaactattaatgcattaatttcatgatcatacttttgaatataatttcttacaactaaagaacccattgaatgcccaaataaacaaactggtaaatttggatattttttcttaatataattagttaattggtgaacatcttcaacgattgcacgggcaccttcaccataaaaataacccaaatcagtttcatctaaaacactttttccgtgtccacgatgatcatgtatgataacaacatatccacagtcatttaaatattcaataaaatctaaataacgctctttatgctcacacataccatgaacaatctgaaaaattgcttttgggtgttccggcgctgaaacaattacgtctaaaggtaatttatcagatattgaattaatttttagatactccatcgtttttctccttttcatgattatatcatattgattgcttgaataaactaaacaaactcttatttttatctaaataaacaaaaacctgcaaattatgcaggtaatcatttttgttcaattgtattttcagtaataactagcttccgcttctttagaatcatattaattacttcactggctaatgaatataaacaagcagcactaggaaccgcaatgaccattccaaatacaccaaataaatcaccgaaaacaaaaattgataataaaacccaaattccaggtaagccaactgagtttccaacaacacgcggataaatgaagttatcttctaactgtgataaaatctgaaaatataccataaaccaaattgccatcaaagcatcttttgataaaattaagactgcacctacaaacattgcggcaattggaccaaaaaatggaacaaatgaaaatattgaaataattgtagcaatcaattcagggtatggaaaattaaacagcttcatagttacatagtacaacacccataaaatacaagcttcaaccaattgaccactgataaaatttgaaaaaacttcattagttttatgtgcataatcaaaaattacacaagtaactttataaccacaaagtgctccaattgcttttcttaattgtcgtaaaaaagtttccttatttccaagcaaatatagagaaaaaataaatcctgtaaatactactccaaatgtagataaaaaatttgttgcattattcatgattcccccagcacttctagttaggatatctagtgcttgaccaaccatatcttgccaaggcatattgattaaatctttaacactagcaatattttccattctaaaatcaatattgaaatagataaatatatcatcgatattattaaatactgatgttagaaaagcagaagtattactgatcaatgaaattaaactgcttattaaatttggaattacgatactagcaatcaaaacaattaaacaaataaatagtatcagtgttgcaattattgataaacctcttttttttcgatataaaaaactagtttttgtacaatattttgtaatttgtttttcaatcagcttcataggctgattaagaatatatgcaataataatcccataaaacaaatataccagcgtccctaacaacgtgctgatcattccataaatattacctaaattcataagtaaatatatcaaaaaaactgtaaacgctgaaattatcaatccaggtttaacatgacgtttcaaatcatcatctaaattaaaattacgcatctaatcactccttattccgcttgattataacatatttatcatacattttataaccattcgtgatatttatttagataaacacgtttaactactgttgtcaatgcaatatataaaataacaattattattaataatccaaaataataagctggcaaactagtaagcccaattgctttagctaagtgactaaatggaataagcgttaaaacaaatgcagataataatgtaaaaatcgttacaaatagggcaggtttactttgaataaatggtacttttgctgttctaattaaatgaataacaagaatttggctccacattgattcaataaaccagcccgtttgaaaaactgcaatgaaataatcaggatttgttaatgattgataacttcctccagccattattggggctataaaataaaacatcaatacatatgtcataatatcaaaaattgaactaattggtcccatccataacataaatcttccaattgatgatgcttcccatgttcgagggatttttaaatactcctcgtcaacacggtcaaacggtaaggttatacaagcaatatcatagattaaatttagcaacaataactgaattggtgccattggtaaaaatggtaaaaatgcacttgcaattaaaactgaaaacatattaccaaaattagaactggccgtcatttttatatatttaatcatattagcataaactttgcggccttcaaccaatcctttttcaagaaccattaagtctttgtctaataaaattacatcagctgcttctttagcaatatctactccactatcaacagaaattcctacatcgcttgcctttagagctaatgcgtcattaataccatcgcccatatatccaacgctatgtccattttcttttaaaactttaataatcagtgccttttgttccggtgataattttgcaaaaattgttgttgtttctacaacttccttcagtttatccaagcccatctttgcaacatcttggcctaataaaatattttcaacattcaatcctaccttttgacaaattgctttagttactttttcattatctcctgtcaaaatttttgttgctacaccatgttccttcaatgcttttatcgctggggctgttgattcttttgcaggatctagaaaagctaaatatccaattaaaaccatatctttttcatcactaacggtacatttttgtactaaatcctgatctgttttttgactcactcccaagacccgtaaacctttttcattaagttgttcaacttgattgataattattttctctaatttttgtgttaacggccaaactttaccaagatactcaacatatctacaaacactgagcatttcttcaattgctccttttgtaaccatctgtactttaccatcttgatcctgaataataacagacattcttcgtcgttgaaaatcaaatggaatctcatcaattttttcatatttgtttgttaaatcttttaagctcgaatcattatcttgttcagccaacgtactattaataattgctttatccattagattatttaatcctgtttgataataactattcaaaaatgcatgtcgcaaaactcttaaatcaattttcccgtgaacatctaaaggaaattctaaaattacttcatcttgtgttaaagttcctgttttgtctgtgcaaagaatatcaatagcaccaagattttgaattgaatttaaatttttaattatagttttttccttagccattgcaagagagcctttagcaagactagttgtgacaatcatcggaagcatttcaggtgtcaaacctacagcaacacttaatgcaaataaacttgcatctaaccaatctccattagtaaatccattaataaataaaacaacaggtaccataactaacataaaacgaatcaaaagccacgatacagaattaattccaatttcaaaagttgttaattctctctttttatttaaatcaacagaaattcttcccagcatagtttcatcacctgtcgcaattaccacaccgacagcacttccgctaattacatcacttcccataaaagccagattttgtgcttcaagcacattcgtccctacagttgtttcaattgcgaatttttcaactggttcactttcacctgttaaacttgcttggctaataaataaatctttagcttcaataattctcaaatctccaggaatcatatctcctgcgctcaaatatacaatatcaccaacaactacttcatcaattggaatctcttttgcttcttgtccatatcgtttaatatttgtagtatttgaaatcattgcaatcagcttctctgctgcactcccacttctttgttcttgaataaagcgtaatattccagatatcattaccataactacaataatgattactgtagttggatccttttcactagtttctgcaaaaatcacattagtaaataaagatactactgctagtattaataaaattgcagtaaatggatttataaaagcgttaaatattttttttaatatagaatcttttttttgtttagtaataatatttttaccaaattcatcactatgatgtttgactgtttcattcgtgattcccattttatttgtttcaaaactatctaaaacttgattagttttattctcactcgcaaaaactaatctctcattaattgaattaaatcttctcattgttataccctccaaattaaattttagagtatgacaaaactatcctaaagaatggcatcgccattattcgggacttataaacatcattgtcataccggccatgctcttccattctttttctcctttcaaaattttagatatagaaaaagccatcattaagatggctaggcgaaaatggacgtaattatcccatcatcaaaaagccatcttttaaaattcatcgataaataatcatccattttcttcacctccacaaaataaaagcctcatcgctcaaacgcgacaaggcataaaaataactttatctcgttcaagcttcaacatcatagggccatgtaattgcattagtttttgccttcacgacaagaactgttgaccagcgcacagtgtctccactgctttgcggtagcaacccgtatccctatggtagtctcacctaccgattcttttatcgcttatagtttaacactattaaagataatgtcaacccctattccccttcaactagctctactaggatttctactaattcttgacttacaacctcataatcatcaccgtgataactaaaattgacttcatcacgacttgtagtggagtctgtatgccaatctttacatgagctatgaagctgcttaattcctgtataatcaagcatttttttcgcatttcctgcatttattccacttcccgctaagatttcaatattctcaccatatgcatcatacaaatatttaatcatttcttttcctcgagttgctttaccttgtaagccactcgttaaaatacggtctatccctaaagtaatcaaaatgttcattgcctcgtcaatatcattaacacaatcaatagcacgatgaaatactgcagttttgtgatatgatttaataatatcgatcatttctcgggtttgtggaatattaatatctccttcttcatcaaggcatccaaatgcaatcccatctgcaccattatcaagtaatatttccgcatccagtttcattacctcaaaatcttcatcattgtaacaaaaaccagcaccacgaggtctaaccatacaaataacttctaaatctgtgttatctttaacttttaataaagttgctaatgatggggttaagccacctaagtgtaatgcactattcaattctattcttctagctccaccgtattgtgcctgtaatgcatcataataactcccacaacatacttctacaattttatccattttatcaactccttacttgtatatttattataacacttttccaaaagcattaattgttatttttaagtaaaagttggtttgcattttgttaatagtaatggtaaaatttatgagcatagtttatttgcaataaataaaaattgtaatataataagctagttctgtccccttagtaaaatggatattacaagaccctcctaaggtttaggtgcaggttcgattcctgcaggggacgccaattataatttataaaaatatattattgaaatcaggtggattatagaccttttaaatccaccttttttatatgaatatttaactttttataatctaacagaacacatacttactatttctttcaaagatacctatacaaaaataggattttcataagcacttttgacataacatattactctagttcaaaagcatcagtatagagactataataaacatcatgctttgaaatgagttcatcatgactcccccattcaataattttcccaaaattcaaaacaataatagtttcagaattacaaaccgttgataatcaatgagcaattacataggttgttctacctctcattaaattatccattccttgctgaacaagcacttctgtcctaatatcaatcgaagaagttgcttcatctaagatcataactggtaaatttgcaacagccgcacaagcgatagaaagcaattgcctttgtcttcgagataaacttgccccattttgcatctcatagataggttcccttccattttttaaagaactttcttcatctgaaacttcaatgattcgttcacatgatgctcttgccatattgatcattaccaatacttgtaataacatcatcagacaattcaaaatattcattgcataggcaatcatacttgataagtcccctgtggtcatcgttgatgcatttataagaataataatttttgctccaaaccagcaaagaaacaacaaacagccataaacttcaaactgcattataggcatataaatgatttaactacccgaattcctgccaaattttcctgtactacactattcaattcatcatagatatgaaataccttttcaaaatatggatgtgaacgactaacaataaaataaagacctgcctctaaaactggaactgcaattaaaaatattaatgataaatccctatttatcattaatgaaacagctagtgaaaatgccagcatgatggtgctcgcactgccacacgaatagtcatcatatgtgcattttgaacgttagttacatcagtcgctaatcttgttaccaaacttgaagtagaaaacttatcaatatttgcaaaagaatattcatgaattttataatacatattctgtcttagattttgagcaaatccagctgaagctatcgcacaaaaacttcctgataacatgccacaaataactcctaaagtaacacaaaagattaagactacaccccatttgccaaaaatactatatttacaagtcaggaagaatatttcatgaatactcaacaattagaatgttttgtgcgaatagcagataaattgaattttacaaaggttgctgaagaattatatattactgctccagcagttgcccatcatatcataaatttagaagaattaaatacgtcattatttatcagaacttccaaaatggcaaaatcaactgagccaggctcattattctatagtgaagcaaaagatattctccaaaaaatatatatggttgagaaaaaagttaaaaaactagccagtcaaaaactttcgatattacgaattggctgttctagtcaagtagaacttgagatattagaaataccattaataaaattaagagaagaatttccaactgtttatccccagattattattcaggattattttattctaaaatctctatttgataataaacaattagacattttaatcagtacaaaagagatgattgctgaggctcacgattatatatttaaaaaaataaaaaacatttccagttatgcaatcatagctgaaaattccccgtttgctaaagaaaaagaaatatgttttatagatttatatgatacaccacttattactttgcatccccgctttatcccattttaatactgagataaattacaagaatttattgctctccatgaaaaaatcattttcatcttttatgtaaaaatgaccaggctgctattcttttcgctaaatgtaattacggtgtagctattttaccagaaatatatattccaacacatattaaaagaattgtcgctttaccatttatggatgatcaaatgacaatagaatatggaataacttatcacaaaaatctaaaagaaaaatatattaaggaatttacaaactattttataactaataaataataaaagaagatttaatttcattgatataatcaattattttaaatcttccctttaattaaaaatattttataacttatcttgattatttgtcatttaattacatgatagataagcttaacatcattatacaatagatgccctatatatttgaagaatcacattctccaaacaagtatcgaactcaacactagtctgatttattgataaatcagataataatgctctagaaaaactcgcaataagcccgtgattttcccttaataacccatttgcctgctctctatcataaccgccagatagagcaacaaccctaactacatgggaatctttcataagttccgcgtaaaaatcaggtacggttggaatggacagtttaaatataaatttaacatcattgtctaataaagttagatgctcattaatttctttcaataacaattcttcagcctctttttttgaggtacttaaaatagatacctctggctctaaaataggtacaagcccagttttagcaatttgtaatcctaattcaaactgctgatcaacaattttcttgatacctgctggatcggcttccaaaattacactacgcatttttgtaccaaagatatatttatctcttgccttgtttaatattgcttccagttcaggaattggcttcattaactgaacaccatctttttctacttctaatcctttgtcaattttcaaaaatggcacgatttccttctttaaccataaatattcagcagtatctacaccctcaatttgagaatccattgtcttttcaaacaaaatagcacctaatatatgcttagaggtaaaagccttactagtaataatacgactacgcatttgatgaattaaatcaaacatttctttatcattactatacgctgattcatcaataccatatgattttaatgcctttggtgtacttccaccactttgatctaacgctgcgataaaaccttttccatattgcatacgctctaattgttttgtgttcatttaagagcacctccttttcctgcccttattataccccttgtccatcaagtattcgaataatacgttctatttcgttagataagaataactatttttacaaataagaatcgcttttaaaaatatgatagattattttaaaatatgctataattaaataagataatctttatacataaggagataattaatatgtctatcacagtaaacatttattacactggaataaacggaaatgctagaaaatttgcagaagaaatggtgaccagcggtattgttgatgctattaaagcagaaaaaggaaatgaaagatatgagtatttcttttccatgaatgatccagaaaccatacttttaattgatagttggaaagatcaaaaatcaattgatgctcatcatgctactataatgatggaacaaattacagaattaagaaataaatatgatcttcatatgaaggtagaacgctatacttctaatgaagaaaacataacttctgctgacaaaaaatttattcgattgtaatctaaattaataaaacccattataaagtcaatattataatgggttttatactattcatatcaaaacatatttctggtaattgaaatatttattccttatttaccattttagttataatttatcctgtcacaattatcgttctttattaccaagtaaatatagcttttaattataaatatataattctaataaaaaaacattgcctatttaacattaccgctgttaattccttcttcataaggatccaaaggtaaccattctaatacatcttgaatatatttattccaaaaatcccaattatgacttcctacatcctctttataaactaaatcaaaaccagcattttctaaatagcctttaaattttcgatttactccaattagttcatcatcacatccacaagccatatatatcttaggaaaaacaatagtattgtcttcttttttttgcctgaattaaattttccaaacaaacttttggattcttatcactcagatatgcttcatcaatatcaccaaaacaactatcttcacccattacacatcttgattcatcgtgaactggtaattcgaaaatatttagagcacttgataaagctgcaatatatccaaaattttgataatatttcaacccatttcttagagcaccaaatccacccattgaaagtccggcaataaaagtatcatcccgacgattagataaatgaaacatccttctagtaacttcaataagttcagttccaataaatataccgaagtcattgttctttacttcttgatccacataaaaagaattatcaccagacggcatgactacaactaagttctttgcttctgcccattcttgtattcttgttcgtgttacccagtcagtataatttcctaataaaccatgtaataaatataaagtttcatattctttaactggttgacaatttcctttaaaaagaaatttatcaaccggtaatattacattcattgaaactgttctttttaaactttgagaaataaaatttacttgtactaatgccataataaaacacccctttactctttttaaatctcatcaattgacatatctgttttataattatttaaaacgtaatcataaatataagcaatttcactaattggtattgttatattatactgattagcaatcgctttaaagctaattctaactccattgataaattcttgattatttttttcaaaatcaacaatattaatatgtgaaactatctcttctttttttattagacgttcaatcaaacaacaaagatgaatattcaaaccaataatagtttttgctaaaaaagtaaaaacttccaattatataaaatggatcttttcataattttcagatattatataaaataaaaaaacactagactaatagcctagtgtcgcatcatctaactcagttttatttacaagatatttgctagaaagagacttatcatcagccactaccataagtggattcatttcatctgtttctacaaaatctttatcatatttataaaaatataatcttaacatcatcatcgctaagatgtgatattgtttttcttcattagttagttcctcataattttcaaagtaaatatcttcaataggtactaagtactcaaatttgtacaatttactttgttctagataattatcaatgatttcatcatcgttatctacgtaattaaaaagatgtccaaagaactctggaccatacttaactctttctaatatctcattattcattaattgatcatcaaaagcataacctttaaatgaataatcatttgagaatctattttttagatagggtttatatttgccttcatcaggaatatcaaccttgttaccattaacatacatttctatttctttatcaaatttaaatgttaatccatattcctttaaatagtttgaaaaactattttcttctgttaataattctaacagacttaatccatcattatcagtatcttttaatcttctagatatactatagaaaggcactttatcaatatttcctttaaaatttctttttacaatattgaaatagcattcatataaatcatcaatatatagtatttgatgatcttgttgaaacatatagtaacctgaatctatagtatctaaaataacctgttcattaagatctaattcattacataatgaatctaagatactttgatatgatgtagtatttaattgcattgtttcacctccgtcaaagcaataaaaattattcttaatttatttttattaatttattcttaattttattaataatattcattatagtattctcaatactaatacttattttattagttgtttttttaatagttattatgtatatataagataaaatgtaactaaacaaataagtaattattccaaataaaaaaacaagtaatagtacatatttataagacagtaattgatatatatatagccacactatcggtttaaaaatatctctaactaaaatattttcgtgtatcatgtatatgtataatgttgaagaagaaatattagtaattaattttgtatttacttttaaatttttaaaaatattaaataaacaaatacctattacaatcataaatggatttatagtaacagcccatcttaacatcttattagataactgaggaacgtaaaatccgatgatatttgttcctaataaaatcaaaaacattaaaagaatagaagaaaataagaatagcttatttgctctatgattttttgaaaaattattaagatatatttttagatatcctactatgaaatataatattacgaatccaataaatggagtatagaaatatacactaccagcaaaaaatgcaataattagatacataatagttattgtaattaataaataaaaatagttttctttactaatatttaaaataattatattaagtagtggatgtaccaaataaagaattatataacagccaacaaaccaattattattgaataaaattggtaataaactttttactattaatgaaatatttagtggagcaccaaatagtttaaatacaataagacatattaccgatatcaaaaaactatcaataattatattaactatttttttaagatttatcctattgctcccaattaaaaaccaagcagaacatattacaaaaataatatttccttgttgacctaaatttctaatcactataagaataaaatttatgattattttagtagaactatttaagtcaataaagctaggtaattcttgatttccatagaatggtacagaatgactaagtataatcaaaaacattgctgttacttttaataaatcgataccattatttctttctgattttattttttttatattcataacaaaaattcataatcttttgttttcataattatgcccccttgaaataatctttttatagttttttttcttttaatacgcgaatgaattttttatacttcattaagaaagttaaagatagttcattatcaaccatctttggccagtaccaaacattatatatcaattgacttattatttgtgctattcccaatccaataattcccaaattaaaatattttaaaaatattaacgataacaaaagacataccattgctgaaaaaagaaatgacttataatagattaatctattagttcctgctaaataacaagcataacaatctctatatttcaataaaccctgataaatacaaagaagcactaatacaagaatattaaatgacatttgtggtcgtatgtatttcaaaataggaacaataattactataactgccatcgatcccattacatataataattcaaatgcaataagtgaaaatgaaaatattctctgtgaatactctttttcccttcgtgcgtatgcttcttgtagtgctggttgatatacactaaacaaagaaccagaaatttgtgcaattgcagaaaataattgtactattaatccaaattcaccagttgctgtcaaacctaaatataaagaacataaaatagtagttacctgatttgaaatataattggcaatagaaacaacgccatctttccacgcattgtaccatacgaccacaaaaatacttttaatatcacttttatcgatttttaattttctatcaaggttcattttgatatcatcaatagaatagaatgctcttttacataacactctaaaaatggctccatacataacataagctattgctacaccaattagatttaatcctaaatataaaagaacagcagtcatagtaatttgtactactttggctattgtccttattttatttacagtaccaacttctcctacaccacgcaaaaacgcatcataataaccataaaataaatttaaaaaaacacctatcgcataaatgatccatgcatatagtatatttatgctaaatatttcttttgatacgtagattatatatattgtacctattgtagataatcctataaaagctattatggaaatgaaaaaatatatcaattgacatgtttttataacttttcctaacaatacataatttgttttcgcatctttattagctttcattactccttccttttttaattcatcaacgccactccaacaatatgatacatttcttgaaaacattgaattaaagccaaaatcaaataaaactgaaatacttcccaaggaaacaaatacattccaaagtccgtacgtatctccgtctaagaatagtacaaggaatgggatcatcaaaaaattcgaaaataatgatactataatgcccacccaattccatattacatcatattttgtgatttttattttcatattttgctcccttataaagattagatttattgctgttcgctaaataagttttcattttaaacttcccattgaaaaataaaataatgtaaacaatagccaaaacaaattgaacattactatacatattataaagaatgaacatagcaagagattgcattatacataagtatatcatcatgttgaacattgtctgtttctttaatacttttagataaaagtattctgatatcattccaaaaagtgcactaaagccgccaatccctacaaccccataatcagcatagaagtaaataaatccagttgtgcaaaaattatacaatttgcctgaattatctataaatacattaccgcccctaattagatcccataatatttggccattagagaaaaattttaaggtattatggaatacaatttcataaacagtattaaaaatattgtatacgccataaaaggttacttgtcctataccttctaaaggtacaatacgagaatcatttagtttttgtgaaaaatttgggagcgtacctacgatatatcgatacattgatgcaaaaaaactttcagattgctggttactacctgaacttcttaatacagtcgataaatatattacaaaaattattattaaaaatataattataatttttttcttttgctttttatcaattacatttcttttaccattatttagtataagcaatgaagaaataatgcatattattgggtaaacaaatgccattcgttcgccataagcaagaaaaaacaatatatctagaaatattgtaagtaaaagtagtttcttttttcgttcactaataaattctatacatgaaacgggtaaagaaataaaaagaaatggaattgcaaaatatgagtgaagaataactattaatgttgatctaactgcatttaaagaatcagaagccacatagcgtagtgtatataaagaattaccttgcagtaagtatcctatcgatggtattgcatatatgaattcaataataatagaaataattacgcatttgataagaatattgtatatatgattccatttcttagcttctaaatttttaaattgatacatggaactagatccaatgtttcctgaaacatttctagaaacaattcttacgaatattgttccaaaattaaaaaatagaattccaactaggatataatcaaatactatagtatcaacatcatatattccaaacaacctaagagaataaaatgaaattaaaatacaaaatgcaccattaaatatcataataggattgaaaaaatttttttcagtaatataagaaaaaaacataaaaaatagcataaccattaataaaaaaactatcacttgttttcctccttcaaattgtacatttcatttttaataatttgataaaacttctcttttagcacattaagattaaaatctttagaaatttgcaaactagaatttccaaatttttcacacatttcattattatcaaataaaatagagacggcatctatcaatccaactttatcatctatatcacaatataaagtattataattattagtaaactcattaactccgccacatcttgtagttactatagcacagccacatgccattgcctctaatacggttaatccatatccttctgatttactagtacatagaaacagtttagtattgttcattatggtgcttacctcactaggattagcattttgcgtatatttgatccattttggccaatcatctggccttttaggagtaccaaatagatgagcctcaagtaagggatatttttcttttagacttaataaaacatctataccaatttttgagccttttaaaacgttattgtgatatagcattgaaatagtataattatttctttcttcgaatggcttgatttcattgaaaatatttgaatcaattccatttggaagatattcaacattagaagtagaatacttgttaattatattttttagccatttagacactgttatttttttcatattgaaagaatatgtattaaataactcttcttcgctaatctcccaattttcatacccttgaataaaatataattttgtacttttatatttattaatagaatttataaatatagctgaacgagcaactgtagctatataaatatgtgaagaaggtaatagtttttcatcaaaattagcaatggttttttgaacaactcttttatctaaatcaaaccattttggtcctttttttgccattatatatcttagccataaaacaatttgtcttggaattccttttgaatttttaccatcacatccattataaataatgcaaacatttaatcctttattaacaatatagttagaatattcatataccattttatatcccccaactattttattcgttggcataggtaatataaaaacgacatcatactttttttcccattttgttttttttgaaatcatttataccctcctttatataactaattttatttaatttatcttgctcatagaacacgacataaaaaaaatgttttgtaaattgtaaaacacttattaaattactaattttatatttttgattataatatagcctatttctagatatataataatgtctaataccactgtgcgttgcataaccatttttaaaattattacctaattgttgatttaatatggcattattaatacgacatattttttttccattttttattatttgtgtgcataaatctaaatccaatctatctataaagtaattcttatcaaaagatatttctccgtaatctgaaagtcttagaatggtacctgaagtaatacaccatttaatcatttcaaattctaaatcatttgtattttttatttttgaattttcttcaacgttaataacacatatctttggacaataaatagtagctaattgattattttttataatgaaattagacattatttgtaaatccgtgtggttgattcgactatcttgatctaacagcataatatatgggtaattttccttttttgcaattatacacatttcatcacatgcaacgcccaatccgttattctcacctgaggctataatttgaatatttttttcaaaaaaacataaatcactattaggtgtattatcatatatatatattttattgaaccacttactcaatttttttatattttctgtatcatcttcagtgggatggaatgttgtaattccagcacaaatatttaaactaatatttttattattttccatcaattttaacaactccttcataatactttgaagaataatcaattgagttattcatccatttttttggagcaagaataactttttctgaatactcacccaagtacgctccccaccatgaaaaagaactattggatataatataatggttacactttgttaaaaggaacataccctcgacatcagacatattttctatatatgtggaaggtatgtttaattccaatcctttagctctttcaatatcatcagcgaaaacaaaaaaataagcatcaggaaatttttcttgaattacttgtattgcttgtaaaaagtattcttttgtgcatacattatgtacattactttttaaataatcatcttgcaacctgatactaattgcaactgaacaagagcaatttacaatactggaataatattcttttgcattttccgatatatatttgtcatccaaaataaaaatttttttaatataatctttattttcatgaaaatattcttcagctaaaaaatagccgtatacatctacgactttcttttttgaattcggaaatccataataatcagaatcaaaagaataataatgtcccattttggcaaagaatttataccattttttccccatttgctttcgtttaccaaaaatatattgaatcaaatgataacttttttgagaaaggcgcaactgtttatatttaaaattatcataatctttataaaactctatattgttatctaacttaaatttttgaatggaacaaggtcttattttataattatgatatgaagtattgtctatatatagttttttgtttatttttttagccaatatagctgaataagcgacttgagacatttgatttcctaatccgcctattaatcgtagaagtatcatcctatttcctcctttgtcgtacagaagttattacatatatgggtaaaattttcataatcagcatttttatagttttcttcattctagttttaaaaggaatggttttttttatggcttcatcaagatttctacattcatcaagatatttaataaaattgtcatagtatggagatttttgatttttaaatataattgatttatttctagaaacaatatcattaatagtttttgatttatattcaaaatttctcaaattattgaataattcaaattcattaattctatcatttaaaaatataattgcattattaccatctatagaaaaaaactctttatcatcttccaatccccaataatctcctactagtatgtctgctttaatagaatctaatttatacttacacgaatagcatgattcgttatttaaaatattgaaagcatcaaaatacgaagtattttcccataactctttttctataatattgttatcattggataaataaaaataatctttcccattatatttttttcttaattgaatattattaaaatcttttgtatacttattcaaaaatttattatgaactttagtacttgttggtccatgacatgctaatgctacaagtagtaaattagggtatttttcagagaaagcattacttaatgccgtaataacacaaggtaatcctataactagaacgagattattatttttcagttctttttctaacaaagcaatatttgggttagaagactgacaatattttactccacgtattttagctaaatctttaaagtcatttacacatatatattttgttgatttaaaatcttcactatatgcaactccaaaaacacatccattattttctataacatatttagataatgcatcacaaaatccaccactagtagattttattctatcatttttaaatttatattttcctgcatatgctctcatgctatctatttggttactttctaaatcactattagctatgcattttttttggcattgtaagcaatttatacatttatttttatcaatttttgcataataaaaaccctcgttatttttttgatagaatattgctgaacttttacaaacattagcacaaacgccgcaattaatacattttttgtaatcgttcgaaggactaatcatcttcttcaccattatgtaaagcaccttctaaataatttatagagctcttattataggaacttaatttcttatttatttcaaagtaatcaatatatttatagtgaaaagcattttgtaaccctgatttcttaactatttgattacttaatccaaagaaattcagtaatgttgtttttctatcatcttcaccataactaaaaaatactttattaaaaataatagaaaatgcaattgcatgaaacgaatctgtaataacatattcagcattttttattaaacctaaaaactcccttggaccaataccatttggaatctgttttattgatgaacttaaatcattttcccatcctggtgaagttatgcatatcaattctaaacctagtttgttggcaagttcctcacattcaatcgatctttctttcttttctctttgaattaaataagcgaatatatatttcttcttagtttctggttcttgtacaacagtatcccattgtgttctatttagaagcataacaggatcgcatactatattaacattttctattccaacagattcaatcagattctttgctccaacttctcttacagaaattgctttataatccttaatttggttatatagtttttgttttgaagtttctaataaatttaaaacttgcatactagccgcataagatatacatttgttcttattctttacaaaatccaaaaaatattcatctgtgcagtaatccatattccatacctggtcgcttcctgtaatgtaaaaatcataaacatcaccgatttggtgaatatttgatttattataggtagatgtatgtggtatgtctgaaataaactcattaaatttcttaatagtattctcatattgcatagaataggttccattatttttagatgatttccatctttgaaagtgatttaaaataaattcttttttcttagaatatggccactttataaaaacaatccctttatttcttaaaaatccaccaccacttactctatcaaaatctatttgctctgaaatgaatcctttattatttaaaaagttggtcaacgcatacgcttgaagttggccaccataattgtagtttttgtgatatatagttattattgctattttattcatgatttcctccattttatatagtatttatatcgccataagtcttaacgccttagtacattaaatgcataattcaagtagtaatataaactttttattatagaaaagttatgatatcttcgatatacattccactgtttttttgctgcgcttactttattcccgctcaatgatgtagaattaattctataataagcaagaacatcatttataccataagcaacatatcctctttccaatacacttatccatgtacattgatcttctgcatgagaaatattaggcatttcaatagttccaacttcttctatattaataacaaccgtcaaacaacctatgatagtgttttttaatatatcattttttttcattttttttggtacagaaataacagattcaacctcctgaggtgttgttataaattttgcatatgaagaatatgtaatataataatcattttttttcataaataaaatttgggtttctaatttattttttacccatatatcatcactatctaaaaatgcaacaaatgctcctcgtgcttttgataaaccgatatttcgcgcatttgatactccgccatttttatttaatgatactaatttaattcgtgaatccgcaagtatataatcattaactaatttagatgttttatccgtagaacagtcatcaattataatcatttcccaatttttatacgtttgatttagtacactttcaattgtttctgcaatatacttttcactattgtaagctggggttattattgaaactaattcatccatttcatttaacctcactatccttttttgttgttccagtaccaccttccacaacaccatcatgtttgagaacagaggctattgtgccaaaaaaacactttacatcaaaactaagtgataaattagaatagtattctccatcaagttttgctttaacatctatctctaattcatctctaccattaatctgtgcccaaccagtaagtccaggtgttacatcattagcatgatatttatctctttctgcaatcaagtcatcttgattccatagtgcaggacgaggtccgataattgacatctttcctgcaaaaatgttgaatatttggggtaattcgtctaaagatgtttttcttaaaaatttacctgttttagtaataaactgatctggatcctttaacatatgtgtaggcatatcactaggagtatccgttctcatagttctaaatttatagatttcaaataattttttatctttacccacacgtttttgtttgaataatactggtcctggtgaatctaatttaatagctattgctaataaacctaatactggacttagtacaacaatagctccaccacttaaaacaatatcaattcctctttttagtagtagatacttcttttgtttatctgtcattattttcccctccatatttactcaaattaaaagatggttatatttgagtaccatcctcaataattcgattcatttcaatttctttattcattgttattaaacaacgactacctatacttgcatatttgttgattcttgtattagggcgaatcactgttcctgtattaacaagaacacattcatcaatttgagcaccgtgattgataaccacacttgatgccaaaatacaacaatctctaataactgcattggcttctattacggagtaggggaatagcacacaacctacccctacagatgcatacttagacacaacacttgaaggatgttttaatataggtaataaatagccaatttctttggcttgtaaaagcagtttgcttcttatttggttattacctagtgcaatatgaatatgagtatattcaggataataagaacttatttcgtcaatagaaccaattacttcacattcattgattgtttcattaatttggttatcatcaagaaaagaaatcttatcaaacatattcatatctcttgcaatatctaaacaacatctgccatgtccacctgctcctactattaataaattcacttcttcactctcccttaaaagaaacttggttcttcaccaaattgcttcttatagtcttcttgccaatcttcattaatttcttttggaattaagtttatgatgatttgattgttaaaagctttaatagatgtaatagaatagttgtttgttaattgctgataagcctctttaccatttgtatattggtattgtttatcatcaataatacatatcacttctgattctattttttctaatattttagtcactctttatacctcctttttgaacataaaaaaacaggttcatcgcctgttttagtcatatttatgaggtagaagatacaattcccccttaccccaaataatctagactttatgttcagaactaatgtgttatcaagttaacctgagtaacacttaattcttgcttataagttcaactcctagaataatctttctatcaaagaaaggtaaatctagttgtgctgtacaatgatgtttcatgactctaacgatataatcttgataatgtagtaggggaccttctacaataactgtcttcccattttcttggtaaccaacagatactctagcgacattatctttatctaatacattattaaagaactctatttctttttctcttaaagcagatacttcagcattctctaattgtttaatcagtccatcattcttatctttcatagacaataaaagatcattaaaatcattttgttttaaatctgactttacaaagatatagttatcaaacatatccttagtagtctttttctttgcttgcctatgaaatacttcagttttaggaataaaggcagtaagttcttttctttgattcaaattagatagtattttattagttttattactgaatacatataagacataccagttcatcttaataatcaatcgcaataagtagttttccagtaagaatttctgtatctaatgttgcaaatcttctatatttatcaacttttttgatcatatcttctaaacctactaaaggaccatcagttggcacaaatcttcgatccactataactccttttgtatgtttgaccgtatcagtattatctaataacttttctagtaaagactgctcttcactagttaatggatatgtatctttatactcaagtaaatccactaatccattaatcgttttaaaatactctttaaattgttcatcaaaagcttctttatcaagatcactcttgataaatacatagtcaggatatatttccttaactataaactcagctgtttcccctctaccaaaacatctttcacttttaggtataaaggcattcatgttcacttgtttgtttaaagtactaacaagttttttagttctaccagttttgcatctggctacgtaccaatacattgttacctccaacccttccattttcgcagaacactatattctacgaaaaaatcagaatcttaaaagaatatcaatttattattgctatctcaaaaagaataaatatttcatttatcgttaattttggataaaatgattaacacaaataaatttattatgatgaaaataagaattgattaattttatctaacgattttcaaatattttttcattattaatttgtttttttaaacacatcgaactataaaaacattagttatttactgttaaaatcatcagataaaacagactattatcttaatagctcaaatacctgataattactgtcaattcgtcgcttttttatttgaaacaacaacaatttatgatataattcggttcgtagaatatagtgttctgcgaaaaataaaaaaaagcgcttatttatagtaattcactataattgagcgctttttctatatgtatattttcctgtttattcaaggacgtttataaatcacaaattcctttattttctccataaacactataccagtcttgattaaaatcatctacagctttttcaatatttggattattaaaaatcgcttttagaacactgactggtgctgtaattgcttgggctccactattaaaagaatctcttacttgctggacacctttgaaactggctgctaaaatcttacaatcataatcatccatcacgattcgatttgacaactcattgattaattcaaacggatcactaccaaggttcccaattcgattaacatatggagcaatataatcagccccggctgccaatgccatatatgcctgcatcaggtcgtaaacagcagttgctgtaacattgatgccttctgcttttaaaatcttgatagctttgattccttcatatgatacaggaatcttcacataaactcgattatcaatttcctttaaaattcgatgtgcttcattaaccatctcatcacaatttttagaaatcacttgaacatgtaagcttctatcttttccaataatatctcttacttttctcatgtgatcaaagaagttttctggtgcagttgcttttacaatagaagggttgcttgtcactcctacgatcggcatatgatctatagcatctttaatttcctctaaattcacagtatcaataataaattccatttttatcttctccttattctatgattaaattttttaaacctgtttgataaactaactgatgaaaatgttccatctgttctttatcaaacatcttcaattgtttatcaacttcatattccagatcaactaattcatattttgcaaaagctaatggattgtagttcaacaattcgtatttaacttctggataaatattaacaagaaaatttgcaatactttttatattatgatcagtcgccgtcattgtcggtatcaatggtgttctgattataactttgtttctatattcactttctaaaatatattcaatatgctgttttatcatttttgatgaaacgttagttaattccatgtgtctcttttcatcaaaaacttttaaatcaatatatattaaatcaagatatgggagtatttttttgattaattctaatgatccatacatagttgtttcaatcgcagtatgaattttctcttcttgacaagcttttaaaatctcatacaagaattctccttgcataagcggttcccctccagagaatgtcacaccaccatcatctctaaaaaacaccctatcttccttgattttttccattaattgttttatatcatacgcttcactatcataacgaatagcattacctggacaagcttttaccaaattatcaaaagttccttcatattgcaaattgaaatacggacgattattttcatatttaatttgattttttttagaaaactccacacatctttgacaatgaatacaactattttcaaaatatattggtcttctttgagatgataatccttctggattttgacaccatttgcaccttaatggacagcctttaaaaaaaactgttgttcttaatccatatccgtcatgaacagcaaatcttttgacatcaaatactaaagctttagatgtcttcataagccgtcctttcaataatctcatcttgcagcttaccagccagttctacaaaataagctgtatatcctgcaacccgaatcgttaatgacctatgttgttctggatgaagcttcgcatccaacaaatcttcacgtcgtactacattgaattgaatatgtggaatttttaaatctacaaatgctcttaaaaagttttcaaatttcatcattcctgtttcagttttaaaaaactctggtaaaaatttcatatttaacaagcccccatttgttgtatacgaatccttcatacgtgataccgattttaaaactgcagttggtcctgccatatctcttccataaactggtgacattccaccatcagctaatggtgtcaaagcatttctaccatcaggtgatgcacctacattttcacccattggaacatgagcacttactgtatacattccggtatgatatagaccaccgcgataatttgtataatctttcattctttccctaaaataaccagcccatttagcacctaattcatcgacccattttacatcattgccatacttcggtactttatttaaaagcatcgtttggatgatttcatatcctttaaaatctgcttgtaatgcttctaataattcatgtctggtaatcatctttttgtcatatacgagttccttgattgctgcaagtgaatcagctaaatttgcaatttgtatcatctggatccctgaaagattgtattttgccccaccacgtgttacatctactcccttttctaaacaagaatcaatgaccgttgataaaaaagctgtcggcaagcaatcttgatgagctttttctacaacaatctcagctttcatcattttttctataaaataatcaatttgtttttgaaaagcattttccaaatcctcaaaactctcataggtttcaatacttccaagatccaaacctattggttcattagttaaaagacattttccatgattcatagttaattccagcgctttatttaaattgaacattgcagcatcagaccagcccaaattgtttccatgtgtcgttaattcaacacatccaacaattgcataatttcttgcatctttttcttcaatacctaaatctttaatcatactatttacaattgcctcatcattaaagaactgtggcatcccactacctttagcaactactttgattgcttcctgtattagttcatgtgaagaatttttatttaatcttactgataaattaggttgtggtaatcctagatggtattgtgcttttaataacagtagtgataactcattataaatatcgcatccattttcatcaattccaccaatcgctatattaaatccgattggaaaaccagcaaaatattttgcactgtgctgattcctcaaatacacaatttgattaaactttaaccacaaacactctaatatttctaatgcctcttgctttgatataattcctttttcaatatctttttgataataaggataaagatattgatccattcttccaggagaaaatgatgatgcattagactccatgtgtagaacaacaaataaaaaccaaagtgattgtacagcctcatgaaatgactgagcaggtcgactagcaagatttgcacaaatgtctgcaaccctttgtaaagatttcttattatcatcttccagactttccaacattgtcaaaatataatcatgataacgcatcataaaatggcagacaccttctaaaacaataattgtacattcataaaattccttttgattttcatcacaattttttaacttttcataagcttttgtcatcaatccttttggtccaagctctagccaagtcttcgtatctggacaaatgtgtccttgagcatgatctttttgattaattttaacaactttagcaattgcattaatttcctcaccataattctcttttatgacatcttccaatgaatggtcttgccaatatggataaattatctccttaaattcttttacatcttccttttttattcggaatttatcttgtggtcttgttggtaaagtctcaaactctttgttaacccaagaacatccactttctggaaatactactccgtacctaacacctttagtgcgattcccaacaatcaactcttctttttctacgccaatttctaattcttctaatgctgctttcaaagataacgctctttttttaggaattgataagctttcattttcttgataaatcctcgttataattcgtgcctgttcaattgaaacataacgtggttcatttaacattttttcctttaataaaataattcttggagtttgttctaaattatccatagctaattctcctcatctcattttttatcgttttttattgtttgtaattgaattataatacatatacaatatttttcaatatattttcaataaaaaataataaaaaagtggctttaaaccactttatcataaaatatctaatccatatttattaataagttcccgttgttgaagcgttaccgccttttcacaaataattcccgtaaaatcatctatatgagaaaaaacataattcccgtctaattttaattttgccgtttcagccaacatataactctttttactagaattaatcacttgctttttagttaatccatcatcgatatcataagttgtaatatttcctgaatgtaagtcaattccaaccacacctaaaaatgacaagtcaaatttataactctttatttggtctatagtaattgcacctaagaatccgtctttaggattattaaattctccaccaataaaaatcaatcttgctcgacattcacctctaaaaatattgatcaattcaatcatattagttacaaccgttacgttcatatcacgctgatagataagttttgccaactcaatattaattgttgaaattcctaaaaaaaccattgttcccggctcaattatttcaactgctttttgagcaataagcttcttttcaggtgaatttaaaccaattcgctcaccgacattaacacgatgaagattagttcgtatctgtgttgctccaccatgaattctctttaattttccatttttttctagtattgttaaatctttacgaatacaatcttcggttacattaaaatccttacttaaatctctaactcttacttgcccttctaaatctagtttagcaataatctgattatgccgttcttgttgtaacatcatgatcatcccttctttgttagtattatgccattatttaaaataaaatacaatgactataaaatttataaatatgcctaatacttttcagccccttttttaactatctttttatccactgtttaggttatacttaagtaattgaggtcaaagttattaataaaattattaaacgtaataaaatgataagtgtaaggagggattattattaaaacaattggctgtttagtaagtcacaaacgaattttagttgaatttattattagtattttgggtctggatctactctatgccattttttcaaacacattcaaaaagcttaattttttatctacaaaatccagaattgtattcaccgaccattatttttatgatgattgcaataatcattgtcactgccggttacggaaatcgacaaattattgtcattgataaaaaatattttaaatattgcagtaatcaaaatttatggtttaattaccaacaattttaccgcattatttttaactgggaaccaacatttgacattcaaataccgctagttaatattgcaaagattgccctatcatacagtgatatttatatactatgcaatcaaatttattgaggctcaaggcgttaaaatccaggattcctatcacttaaaagaagctttagctaataaagacatgcgttttgctgaatatattgaaaaaacaagtaatcatttttaaagaaattacatctattcatgacctgaaaaaaatttttctccacccaaaatggatagacactcaattatatttatcattgataatcaagaattagtgttcctttcattaagttaccatcctttatgctttattggaaaaaaatgatttagaaacagagcttaatcacgctatttctttgttattaaacctgcataaaaatattgaacaaattttaacttttaaaattgggtattcttatattcaaataaaaatcaatcaaataatttggattgaatcattagttactatttaattatccacactcagcttggtcaatataaatttcgaaaaaacttagtcaattactcgatgaattagctgttaatcaatttatttaagttcacaagagctatattgttaatcaaaaccacattgttattcgaaaaagtaatgaaatagttttaaaaaataaaatagctattccgattggtcggaaatttaaaaatactaattaaaataaaaaagagaaatagaaatgcctatttagcataatttctctttttcgttataactacttttgtttatttacttctcttcttttcatttctaaaattccaataatcactaacaatgaagctgccataaaaatcattggtaacattgatgaagtgtcatcaccagttttaacaatagaattatttaatacatctggatctttatttacttctgcttgtgtatagtccttagcgactaatgtatagattgaaaaacgatcagtctcaaaagtaataatattttcatttgctaagctagattttaagccattagcttcattatcgtgcagtctaactattccaaattgacggtttttcttaataaattcactaggaattgtcatagataatttgattggagacgccatttcactaatttctacaccatttatttctgggatgatcacgtcatcttttgaataagctgtagccgtaatagaaatatcgtaataagctaatattttcgctccatcctctaaaactttttcaatcttatctttctgatctatcgttatgtcactttctgttagatttttcaatgaaagttgagctttaataacagttccctcaggtaaatttcctaaaatttctgcatagtgtttatttaaataactcatcacgcttgtttgaactactttttgcgattcttcagcaagctctaatttactcccacctaagtgctcaaccacagtttctacagttattttatcagcaggatcttgtccattatctcctgagtcaccaccagacacacttgataatattactgctggacaatcgaattctatactattttcagctttatcatttacatatacatatgtaatttttgctggtgtaaattctatttcaaaatctttattactatcaattctaattgttcctaaagtaatctcttgctgttcaaataacttagttttattcgataataacaaatcaattttattttcggaaagattataatcatatattgaagctagtttctttaatccttcgtccaacataaatgcattttgatattcttgaattgattttgacgtattaatagataaatgcatcgttgcaatttgacgttcaaacatttcttgacttaaatgtagttttactgtcaactcatcgccagcttgattaggtgtcaaaataatatgtggcttatctgttgtaatttcgtgttcattatcattaatagcataaatattagttgataaagataaacacattactacagctataaaaaattgaaatatttttttcattatttaccacctctcttttgatttccgattgtgattgaaggtaattcagttggaattttcacttcaaaagaatcacttactaaacgttgaccagcatttgtttgagcatcgttaacgcgatacaactctggtttaattgagccaggaagttcaactttaacaaaatttccttcatcatcttgatatccaaagctattttctatgatttttccattttcatcagtttcaggaattaaataataaatccaagttccttcactaacatcagctagatccccatctccaggatcttctgcaaaaatagcttgatagccacttaaaatttcatctttattatatcttaattccacaacattataagctggatttccagcatatgttcctgtaaagatcaatgatccctttggaattgtattatttgcatctagtttataatcaccgcttaatataccaatactattttcttgcgacatatcaatattatcacctgttggtcctaagacatcaatttccgataaactaatatcattttcatcaacagcaacaatcttaatataactacttgaatatgaaaccaatgatttattattttctaattcatcattaacaatctggctaaaatataatttattttcttcacctgtttttaatgagtcttcttttactaaagtccagttgtccttatcatcacttacataaatctgtacttgattaaatgatgggttggttaatttaaccccggttatgtcagccaaagtatttagtgaaacaataaattcaccttgttttgtatctgtactccctttataaacattttgataattgttatcaattaaatcgtttactgctttttgttctggtaaacatggtgttgaatcttcatcaccaactgcttcatcattatctgaaataagattagtttcaatcagccattgatttttatcaagacttccatcatgagaaattttgattggttttaaagtcaactctgcagttcgatttaataatttatcatatccaatgattgaataagtaaaaacacgattattaacagttgaaacagtatctgtaaatgttgtttcaccagtttctgcatttacaaatccaactgcttgaccgtttcttaaaatttcataacctaacattgctccatcaactttatttgtgttagaaatagttaatgttacttgattactatttttgtcatttgataatgatgcattaatttcagtgtctacagacattctagctttaccatctaaacgataagccattgaatcgtcatctaaatattgtattttatctgtttctgcttcaaattggctaataaatgctttagtttcttcatttggaataattccccatgctgtaaagaaatctgttaaatctttgttagctgctgctgaagctaaacgtacaaagttttgttgagcatcactgtttaattttaatgcagtaccaccttcaggaatattcaccttcccaggattacgagcataataatctactcgagcaaagaacaatgaatttaattgttcctcgtgtgaatcatataatttataatgataattttgatcataagctaaatgtaattgccaatacattgccaattgtgtaaagacattacttgacattccaaccgtatttgaagttactttttcataaacatctggatatttaaatcttgttgtatcattagaatcacgattttgtgataataatgagaaatagttattagttatttctgcaattgcataacttccttgattaatgttatgtccaatttcatgggcaattccccaaccaaataaagaacccgataaatattttccattttctgctgcttcaaatggaattccatttgataaaccagatactgaaccccattcaattccgatatgatttccaccagcgtacataaaagcaccagcaaacattctttgataacggatatttaaatgctgagcaggatagcgatcattaatagcagctgcattttcattaagccccttattttgatagaataattccatcatttgatccattgcatttaatgaatttaataattgatttgccttttcatctaatgttgtaccttttaaaccagccatgatttgtttacctgatactgagtacagcatatgatcaagcataatctcagtagctcctaaaatacaatttttctcgtcataatcatagttaacactattgtcatcacgatgaagttcttcgtgttttgaagccattttattaatttgtgtttgtaaactttgaagataagtttttactttttctaatcgttcattttcatcactaacttgatataaatctaatgtagcaatcttttcaccgcctgatactctaacagcaatcttttcattagaattaccagtatattgaacatacacagatccacctttttcaactccgatagactgtaattctttcatactgatttcatttttaccaacttttaagctaattggactactaacaaacgaagctgattcagcatgatattgcgaatatacaagttgtaaattcacagcttgtccattacgttttccttcttgacctacataaacgataaatgtatcaccaggatatgtaacatatcctaacggttgccaagagtttaatcctccaaatccaaggtttccttgtttacttgctgcaattccattatgaatctcttgaatattttgtagtgcagttccctcaacaacttgtcttgcttgattaagctctaactgaattaaatctttaaatggatgtaattcttgggatacctcgtcaagtgtattcaatctagtttgtaaatcatcaagcgttgtagaagtaacatcatctcttacagttaaatggaatgaatctgtaaataaagcattgacatcttcttctaatgaatcatagtaataaaaattaaactctgaaatacgcattgttcgatttgaactttgtactccaaatctaactttattagtttttattggtttcgcaagatgagcgataaaataaattcttccgttatcatctgtttttcttctgaaagcatcgatcgaagcatctacttctttaccactttcatcataatatgaaattccaatattattaatactactatcattaactggtccagcaaatgaaatatagttcatttcataggtatcatcaaattcaaacgtcaaacgccaattacggtgataactaactccaaaatcccagtcattgatttgtagataagaatcatagttatcatctactaaagctaaagcgctattagttgtcgtactcacttcatctaacgggctatttacgatttctgtaactccattatttccgtagtaaacattattgatatgatttgataatttcccttcaccatttgaagtattaagcaatttatattgtggtaattgagcaggtaaaatattaaccgtcgttgcttcacttactaaagaagctggccctgtaccttttttattattaccagtaacatatacttcatatttagtattatcctttaaagaagtgattgtatatgaggttccttcgtatttacttacagcctcaatatactcgccattccccttttcacgataaaaaacattgtaagaatctgtactcttcatatctttccaagatacattaatcgagcgataagcaccaactgcttttacattatcaggtgcatcaggaacttttgaagcttgtggtgtagcctcaactgcagctgaataatctgattcccaaagtgaatttttatcagcatcattaatcgctttaacactaattttatatgttttaccatttaatagatctttatcgttaaatgattttaaattaaatgaattgacattagaggcatgctcctcagtcttaccattataggttatttttactttataacctgtaacgttatttaatgcatcccacttaatatagagttcttcatctaactcatcaactgtaattcctgtcggaatatctaattttggggcaggaatatgatcttccatcccatttaaaaactctactttagaaatttctgctaatgatttagaagatgttcctgttactttaatcgtaactttttttactgcaatttgagttcctaaatcaattacaattgatccatcagcctgaacgattgcttgtcgtgaagccatgcgagcacgtgatttagctgtactgataactgcttctatctcttctccattctcagcgacaacaattacactaccttctgttattgcattttctttagtgccttgaatcgtcaactgtgtaactgctactggctttttaacttcaagactcatttgaatcggattactttgtgaaatttcttcatctttttccggctttaacttaagcgtttcttcttgagctgtctcactaaaaatattttctatttttccctctaaagttccttgtaactcatcattatttaatgagacattgtttactaacaatggctgagtttcaataactggttccaatcttgtaacttgagtagttccattatcactataagcatatgtaaaagtgtgtaaatctaataaatcaattttattattatcatcaatatctaataaagaattagaactatcattattaaaaatggcagtagataatatttttttatctttgctatcaattttaccatccttattaaaatcaccatatgcaaatgtaccaaatccattgccttcaatattatcagcaactgagtttgtattgacatactttacagtagtttcactgttattaacaacaacctctttactaacagtttcataaccatcaccttgaattgttaaagtatatgttccattaacaatattcttaaattcaaagatttgactattttctttagtcgaatctaattctccagtgtaagtttgttcaatattagctaattgtgctgacaaagtactaatattctttttaaaatactgcgtattaataatcagttttactttacccgttattgaagaattcttaacatcagctgttttttctggcgacgttgattcattattaactgttttttcattagttatcattgaagaatcgttttcattttttgttgattcaccatttgtaactgatgtagttatttcttgcccctgactttcattatcagcataaatagttaactgtgttgaccccagcaaaacaactacgacaagaaaaaaagcaagtattttcttcattgtaattctcctttcctatttgttatttttgtccatttaatgggcttaactcgcattgcaaatcaatgttacgttatttatttttactgtgctgtttctattttatgcgcacaaaaaaaatgcacacataaaaatagcgtacacatacacgaatgaatgcaactggctgccatatcataattgatgaaggccctatagctttgcgtacttcttttttcaaagagtttgccatatttatgaacgccatgattatacaatgactatgtgataatgtcaaaaagtttgcttaaaaaatgtattataaaaaaaacaattttattttcactaaaaaaacctccaaaaccaaaataatcacctttatatcatgttatttttattccaactcctctactattttaaaatcatatttttacatatattaaaaatcaactcataaaaggtgttttatcctttgagttattgaactaataacaactttttgaaaataaatacaatttcccaggtaataaatttcgatatttattttatataacaaaaaaatgactagttaaataagctggtcatcttttcgttatattatttattacagttaatcaccgattaaaagactaatttctttattttcccaataatattatcaacttaagaccagatcttttaaacaatttatcaattagaattgaagcctcaaaggcagtcccggatgtcctgaatttgccttttcaacagtatcagcgcataatactctaatggtactgactgtttttctatcaactgcttccatattagcctccaaatactgctcgatagtctttttggaatttttcaatcccctcagcagtcaaaggatgtttcagcatttgttcaataacactgtaaggaacagttgccagatccgctccggctttagcacattcgataacatgacaggcgtttctgacactggctgagatgatctgcgctttgatatcatgcgttttgaatattgcggcaatatctctgatcagctgcagtccgtccatcgagatatcatcgattcttccaacaaatggagaaacataggttgctccggctctggctgccaggattgcctgcggaacattaaaaatcaatgtcagatttgttttgatcccttcaccagacagtacccggcatgccttcaagccctcagcagtagttggaagcttaacaaccatattcttatggatttttgcaatttcccggccttctttgatcatgccttcagcatcaacagttgtggctttgacttctccgctgataggaccgtcaacaattgcagcaatctccttaattacctcattaaagtctcgaccttctttagcaataatagagggattggtagtaacaccacaaataacccccatatcatttgctttttttatttcttcgacattagccgtatctaaaaaaaatctcatataattctccttttatctaaattaaaaagtttggaaaaactatcaaattacaataatttatagaaaatttatcagggaggataaagtcgactatttgcagtaattatttaattttccaaactttctagattgttattttaaattgttttttaaatcttttataattttttcagcgtttagattcttgtaatcctctgcacctatttttaatactaatttatcgggaaacatctgttgtatctttgcatagttaaatcttacttgtgggcttaataataaaatttctgcttgaataccttgagtcgctacttccgcaacaggacaggcaataacttgatactcttcattgacttctctaattaaatcatctaatttttttgtcaataatgatgttgttattcctgcagcacataacaatagaatacgtttcattattttaaatccaccacatacaaagcatcatgttcaaaaatatgcattccaaccatgcatccaccttgacaagaactaaccgtccccacttctcgatgacgtgtttccaaatcaataattgtaatcttgtcaattgctgtagtttcaagttttaatttaatttttgtattttccggaacataaatcaataatagcttgttattagttaaagccgcacgaatatcatcaattccattcattaataaattttgagctgatgataattcagtaatttcataattatcaaaaataactttaatatcactataatcccaagcacctggataatgaatagcaagatgccatggattcggggaatcaaatccttctcctacttcgtttgcaaattctttaccataagtatgccaactgtaaatgccagctgccccatatgtgattcccgcaaaagcaccggttaaaatactttgccaagcagctcgtctgatttcaaattgatgaaaccgaccatacatatttgaggaataccccatttgttcataacacggttctgaattcaataatggcttaactggataatgttcaataaaatattctggtaaacaataaggcatcgctctattttccagctttgcattatgcccggattgaaacatataaaagtccatttgtttaattagtttctcaggaatttccatcaaacgtccacgtacgtgtagactttgtaaacaattcggtgctaattcatgtagtaattgacttgctttcaaataataagagcagctaatttcctcatttaaatcagtatccccgctgattacatataatggatccaaatcagtaaatgtctcatttactttttttatgtatccatcgatctcttcgtaaggcatcgtattatggctcaacatattatttgcccatgtcgctggtacataattacaccataaaacaactagtgctaattcaaaaccatattcttttgcaacttcacacatactacgagcatgattaaaatatgaatcattcaatttatcaaattgataatcacctttttcatctttttgatacggtgaatgatttaaatcagtagcactagcatcccactgcggcaaaatattaatttgtagaacattatatccttgtcgcttacgatactgtaaataatatttccaatcattttcattaatatttgtaaatgcactccaacaagtatctgctaaatagaaaaatggtttaccattcttttcaaaactttttttatttattgctactttcaatcccattacttttccccccttactaatgcttttaatacttcattatcacaatcatatggatctggtgtcaaaccttctatatatttacaagcttcaaatacttgtggcaaaatatcttcatatattcctgtacagtgatgtacataagggccacatactagtttatcctcaagtttttttagatcatctacttcaatccaaatataagtaccttgattaaatggtccaggaattgtttttgcttttcccattaataatgaatattcaccattatcaccatcaaatcttaaaattgtcatctccccttctttaattttcccatgaagactccctgggtgagaatgattaaacgcaaatggtgcccctaatcttggcttttcttccatcaaggaaatcggccatggaccacagtgttgtaataactcagcattgttgtttgttggatgaggaacagtccaatccgcaaagaaagtaacattatcttcaattgacgcagcctgtgcaataattgaagtgatagcaccatgaatatcagtttcacaagcaacaggaaatttttcatctgttaataaagcattagcagcacacggaaaaattcctaatactccctgcatagcgttccagcattgaacagccgcagccttacaattatatctttttgcaatacttttgattgctacctttaaagctgctacttttactaaagcttcatcactaatttcaattatagtttctttttttagataatcaattacttgaattacttcatcttttttattttgctcaactgcatccatctcatctttaacttcagctaaagtaaccggatggatcttaatgttaaatttctctagtaattcaccttcattaaccatcattgtccaaaaaccagatggtcgcgttgcaatttgtaatattgttaaatcttttaattctttaataatatttaccgttgctaaaaatcgtcttatcccctcataaaattcttgatcttcaagacgacacattggcagatatgtgaatttacaccgaaagcgtcttaatacctttccagttgcaaataatccacactgactatcacgcaaacgacttccatcacctaaaggactttcatcacgcggtccccaaatcaaaataggaagattcattttttttgctacttgtgcaactaaatactcagttccaaaattacagtgaggaaagaacaaagcatccaccttttctttaatcattttatcaacgactttatcaacatcattatcatcaaataataatccttcgtcgttagcatcctcgatatcaacaaaagtaatattcattgttgctaatttttgtaaaatcaattctttatattttaatgcctcttctttgctaaaaatatctcttctcgtcggaataactcctaatttaatatttatcatttatttccacctcattatctagtttggctactgctaaaactccttttactgcttgatgccagccataaatatttgcatttctcaccttttcgtccatagttggaaaatattttttcttatcttcataatattccgtttgtccaaataattttaatcgtgaaatctcataagcccccatagctgaaagtgcataattatatgacaccttaacttcaacatttaaaatatctgcaataaattgtaataaccctatatttgaaactgctccaccatcaatattcattatttgattagatgtatatcctaaagcagttgctgcatcatagatttgataagcaatcgattctaagcctgctcttaaaatgtatttataatcatgattacgagccagcccacaaatacttgcacgcgcttgatcattccaccaaggaacacttaagccaacaaatgcaggaactagataaaccccgtcattattctctatttcatcccagatgctatttaactgtgcttcttttttaaataatccaatttgattttttaaccaattaagagtatcacaactacaattaataattgcctcttgagcatagattatcctattttcaacacaccagcctactgcattgactattcctttagttagttgtggtttacaactacccgcattaatcattacacttgatcctgttcctaaagttactttcattgaaccagtttcaaaacaatgctgggcatatagcgctgcctgtgaatcaccaatcactccacagattggcacttcatgatctaagataccattaacatcactataaccaaatatctcgtcattatttaaaatggctggtaaaataattgatggaatatcaaaaatactacatagcatttcatcccatttcaaagtttcaatattcattaataatgttcgtgatgcattagtaacatcactaacatgttttttaccattagttagattataaatcaaccatgactccattgttccaaaagcataattatcaatttcatcaagtttacaattttcaatcaaccattttatcttcggagctgagaaatacggattgatttttaaaccggttaacttttctactaagtcttgatggatttttaatttttcacacattgaggctgtacgacgacactgccaaacaattgcatgatgaacaggctttcctgtccttttatcccaaagaatagttgtttcacgttgattagtaattgctattccagcaacttttgcgactaattcaggaaattctttttttagcgtactgacagccttaagtaaattagtataaatttcttctccatcatgttcgacccagccgttttgaggataatattgttgatgttgataacttgaagaagccagcatattactctcttcatcaataataaatactttggttgaaaaagtactttgatcaatcgttaatatatacttcattacttttcatcctttaataactgtttagcaattgaaactacattttcttttgttaaaccatagtattcaaacagctgctgcgagtttccagaaattaaagtttcatctggaattgctaatgtcttcactatacatggagcttgattagctactatctgactgacaatgcttccaagtccaccattaatgctatgctcttcaattgtaataattctttttgtatcttttgctgctttgacaattacttcttggtcaaacggtttaatagtatgcatgttgattacacgagcctgaattccttgaagctctaattgaatagctgcatctaaagctaccctgaccatctctccatatgccacaatagaaagatcatcaccatcgtgcattattttagctttgccaatttcataatcaaaattatcatcatgataaacttcagaaaccggattacgcccaactcgaatataaactggtccatggaaatcagccaatttattcatcattttttttgtttcataaggatcagccggaacgatgattgtcatattaggaatagcatttaatactgctatatcttgtaaagaatgatgtgacattcctaaagctccatagctgactcctgcactgattccaatcagtttgacatcagttttagaataagcaacatctactttaatttgttcaatcgaacgcattgttaaaaaacaagccggtgatgcaacatacggtttcattcctgcagcagctaaacctgctgcaattccaactaaatcctgttcagcaattcctacttcaatgactcgatccggaaattctttcgtaaatggagttaatgaagcagaaccacgagaatcacttgtaacgatacaaatcttttgatccgttttagcgaactcttgtaatttttcacaaattactgcacgattagcaattttatttcccatttataaatcccccaattccatcaatgcttgcttatactgtactgcatctaaaacaccatgatgccatgatgcctgattttccataaaagaaaccccttttccctttactgtattagcaagaattaaagatggtttattttttattgcttttgcttgagtaaatgcattgattatttcttcataattattgccatcgatttcaattacttcaaaaccaaacatctgccattttcctttaagatcttctaaagtcataacagtttcagtacaaccgctgatctgcaaatgattacggtcaacaatagcacatagattatccaacttataatgtccagcagccatcgctgattcccatatagaaccttctgccagctcaccatcccccattaaaacataagttcgataatcctgccccatcttcttcgctgcaatcgcaagtccaacgccaattgctaatccatgtcctaaagcaccagtattcatttcaacaccagccactttattgttaggatgaccaatatatttagtattatatcctgaaaaattatctaactcactgtatgcgaaaaaacctcgcttagccaatgtaacatataaagcttctgcaatatgtcccttacttaaaatgaaccgatcacgattttccatcttaggattatttggatcaattcttaattcgttaaaatagagaacatttaaaatatcaattgctgataatgaaccaccaacatgtccggcttttgagtgatagcatacctcaacaatatcctttcgcaattcactagactgtctctctaataactctatctccatctgttagctcctttcaagtaatcaaattttaaaatatttattttactatctttttaaacaattgatcatgcctttatcatttcactaaagacatgatctttcttacgttgatttttaataatcatctctgccaaactttattaaatagcattaaatatttttatttggttttataatctattattttcttgattatccatttaataaagaaaggagtacttacaatacatttaatttatatattatttcaacacctgtgttttattataatcaagactatttgtgaatagtaaaactttgttaattaggcttcttcgtgtcctttagcactaatttcttctttgtagcgttggttatctgatactttgaagaatggataccaaactaaacatccaattgcgatacaaacaacttgaagaactgctgcctgccatccccctgctaataatggtttaataataatcggcatacaccatggtacttgaactccagttaatggtggaacaagcccaattgccattgcaaaataggcaactaatgtttgtacgattggtgttaaaataaatggaattgccagaattgggttcataatcaatggataaccaaaaacaaccggctcattaatagtgaataaacctggaacgattcctaatttgcccatttctttattttgtttagatttagcaaaaagcaataagatgatacataatgacaatgtccctccagcaccaccaattccactgaatgcatcatagaatgtattccctaaaatattaggaagttcctttccagctgcatatgcttccatatttgctgttgccattggtaaatataccgcagtgattacccctgaaataacatttgaaccatggattccaaaaaaccataaaaacatttgaactaaaagtaatacaactaatgaccagacgcttccacccaatgcatttaaaggtgtaacaattactgaatagaccatttgtgaaaatgatccccatgaagtaaacgaaaaaccaaatgaaacaaaaatgaaaataaatccaactaaaatacctggaatcaatgccgagaacgtatttgcaatcattggcggtactccctctggcatatgaatctttaatttttctttagtcataaagaaacaatataaacgtgtggcaatcaatgctgcaatcattgctccaaataacccctgtgcccccataaactgcatcgataaagcactttcttcagttaaaggcgttgtaataaaaaatgcaaatattgaaattaatcccgcaggaatttgatcacatttaaaatgaccagctaaacgatgcccaattaaaaatgaagcatagatagataaacagcttgtagtaactgtggatgctgctaagaaatatttttctatcccagttgattgaatgaaattaagccatgggtcaaagggaaaaactccaaataataatgccagtgaaccgatcattaaaattggtaaagtccccatcaaccccttggaaattgaatcaagataaatatttgccgctatacgaccagacacttctaatgctttgttaataaacttgttattttccatattccgtccctcttaatataaattaaatgaatttgtagtgttgcaactttctacattattactatactaaacgtttttattatcatcaatataaaaactaaattttttatataaaacaactaaatattcactaaatataaaatatttagctaaattttagctaaataaatcttttttatatcggtttataactattttagttaaaatatttaacaatcactaaatatatttgtaatttatttagtgattgtttataatagccttaagagaggtatacaaaatgaaaataaaaataagtgatattgcaaaaaaagcaggagtatctgatggaactgtctcaaatgcactaaataaccgtaaagggattagtaatgaaaaaagagaatatattttacaaatagctcgtgagatgggatattttagaaaaaatagcgatcaagataagttaattcgtctactgatcgttaataaacaagctcacgttgttggagatactccatttttttcagaattaatcaggggaattgaaactgaatgtagtggacaaggatttgaattagtcatcaatcatgtagatgcagaaatcttaaaaaatagacgtttagaagatatattaaaaactgatcaaactagtgggattcttttattagggacagaaatggaagttcaggatttgaattattttagaaatatttgtattcctttggttgttttagatactgcatttagagatactaactttgattacgtcgccattaacaatgttgatggtacctacgaaatcgttgatcatttaattaaaaatggccatacaagtattggtattattaattcatctcatcaaatcaataattttagggaaaggaaaaatggctatgtccatgctttaaatgataataatttacttttatcacctgaaaatgaagcattagttgaaccaacgcccgaaggagcatatttggatatgaaagcttttttaaattcctttttagcagaatttcctaaagaaaaattacctacagctttctatgctgttaatgacaatatcgctttaggagcaatcaaagccttcaatgaattagatttatctatttcaatatgcggttttgatgatttgccaatttgtgaattaattactcctgcgcttactactgttcatgtcaataaacaatatttaggcaaaactgcagtatcaagattagtacaaaaaattaatacacctgattatgatattcaaaaaatattaattgcgacaaaaaccattcaacgtgatagtgttaaaaaaagataaaatcgttactgtataaaataacgatttttttaatgtttgtttttaaataaaatcagcgcctgctgtatcttataagtacgataaaaatcagtcaacatcataataactacataccctaaacaaaataacatgtataaattagtttttataaataaacaaacgatcattccaatagctatcactgttaatgttactttaggatattcaattaaatcaatgattagataatgccatgcctctaaaaaaatactgattaaaagggccaacaaaaaatataatataatcacttgaaaatcagtgtttacaatcactgtaggagtaattagatgcctaaataataagatataaataaagctcaacgatagatttatgcctattctttctagcacttcaatcaccttatttctaacctttctttaaatttcttcaaataacttcttgttaggactagcatgattccattttgcatatacaaggtataacgagaattcagttcaggcagcatatactcaatataattaatatttacaattatcgacctatttatccgaataaagctatatttatctaataattactctaattcatatagtttataatgacataggtactgacatgtctgtgtgtttaaataggcctctttggaaaatccttcaatatagacaatatcttgataattaatcctatgtatcttctcagcaagataaccaattaaataccgttcgagcatctcatttaaatcactttcaacactttttaaattattgagtgtaaaagtataatgtaaccctgcatattctattccttgttccactaaaataatatctaattcttgataacgagcaaaaaatgtttctaatttttgacgatgtttctcattacatattaatttcaattttttagctccaattgatataacaatgttttgcttttattattttcatcatatagaattatttttagctcattatcgtttttaattggtataacacatggtaaaccagaaatataattgttcttaattttttcattataatacagctgatattcatgatttccctgaatcaaatatgctttcagtattttaaaattagtattttttaaatgaatgtctggtttctttaatacattattttcatctatttctaaattttttatttcaatttcattatttcgatatccataattattactttttactttagtaagattaacattcatgtctagtggtttataaccatctttatcatataaaacaattgaaatatatggaccataatcgtactcaagatcgttatcaaaataaacatagtcaaagattaacttttgatatccagtgtgctgtccatcattttcactagtaatatcgatagtatcatccggcaatactgaattatcattaactttaatactcacttgtttagaaatttcaatgagttcatcacgaatataaatacctgggtatgcaacaattttagtattggtcgttttaagtgttcctgttttattattactctcattccaaatagaacaatattcaatgatcacatcatcatttcgataagcataaatcgcataatttgtaaaaacacttcgatcctctaaacgatacattatcggatcagataaaaaagttattccacctatactcatgatcaaagctatgattgcaattagccgatatgttttctttcgtgggtgaactcgcttgattaaaattttcgtatatcgctcacttaaatactgatttatcttatttaagtgatacgtaatgcagcaagccttataaaatatatatccatagattccaatcatagaaaaccatagtaacgaaacgaataaaatatttaatatcggaaatgataaaataaaattgataattataaagtttttaatatgtttttgatatttttcaatttcaatataatcgctacttattctctcaattccttttaatacaaaatataacattgcaaaactaatcaatcctttaacaaaaacaaattcattaaaatcaataccttggttcaataaaaattactatacataaagctattgttaaaattaatgcataatcaagatacttttctcttaaccgtttacggatacataaaagtcctaaaatcatcaaaagagccgaaatataggcaggaattaaatttacatcattgatcgttaatttaagaccatacataaaaataaatgctaatgcgattaaaccaattcccataattattacctctctctacttcaagtatatctaataatttagattgtttcatgccttttggtctaaattgcattaaattagcctgaattacaaaaaaatcacagtaaatactgtgattaccaacgttttataattacatgcagcttagctagatccatctctaaaattttaccaatttccttttttaaataaacttcatttaattttgtcttggcaataaattcgttattattcttttcaaattgagctaattttttaaatctctcatcttcacatagatcataataatagccatcgtcaaatgatacaactaaaatatactcatgtggttctttattactacggtgactataccaatatacaaataataagattaaaatgattgcaaccgccccaataatataataaatattcattcttctacctccgactatatcaatttaactaaaaaaactttaccttattattagtaacaaatttgactttgaataatttttttacttaatcatctaaattataacattttataaaaagaaaatcccgtagaataataacattctacgagatctgggaagtaattcatttactatttatattctatcatatgataagtattttttctaccaatccagctttaaaaacaaactacccttttagtttattccgctgctccatttctctttttactagagtactttcataattatctattttatgctttaaatagctgatgatcgactgtaattcttcaacttgtgcttctaaatttcctaattgttcgatcataatatcttttctttgagaaatcgtatgctctccttcattaaataaatctacatacaactttatttgctcaattgtcattccagcagcccgcatacatttaataaaattgattcgacgcaaatccggttcctgataatctcgatgaccactaatattttttgctacaggattcattaatccaattttttcataatatcgtaatgttgtcgaactaatcccaaattttttactaacttctgcaattgtcattttcatcaccctctttatataattataagtcataatttgtagaccttcaatttttattttaaccgataaatcttcatttgagctaaacaaagaatgacaccaactatttgcattaatgccccaagataaaaaatcatccgataaccactaaaggcagcaataattccccaaacaactgaaccaattgcatacccaatatccattgcagcataatatgtcgcattagcaataccgtttttactttccggcattcgcttaattaaaaatgtattaacaatcggggcaacagctccagttgcaaatccagcaggaagcgctaaaaacaggagttggtacatcctagttacttgaccaattaaatatacactaataaaaaataataaagaatttaataacaacattttgaactcaccaaaatgaataactagtctattcataataaaacgcgaactaatcattccaattgcatttactgaaaaaaacattcctgctccagcaaatccaagactaattgcatatagagaaacaaatgaggtaattgcactttgcgtcaaggaattaaagaataatactaaaatcggaacaattaaaataagccaattaatagtttctttctctttattttgattttctatgctaacaattgatacatctttacccagcagcattaacccaaaagttaaaatacaaattaataatgaaacaataaaaagcaatttaaagcgatcataattagctcctaaaatactataagcaatcgatggtcctactacccctgttaaactgttggcaatagaagcataactaaccccttctaataatcgattaggatgacacattttggcaacatatgtactagccccagttgaagctattccaaacccaatcccttgcattattcgataaataatcgccaattcaatttgcttacagtcaataaagaaaaatgctgcagccatcatcaacgttataccacctaatattacttttttacacccaaatttatctaacaaaatacccgcaataaaacgaacacacaaagctgccaaagtaaaaattgatgtcatcaatcctgcgtatgtatctaatccagttaaatttttagcaaaaatcgttagaaccgacaatacaatattggaacaaaggcatattgcgaaaagaattattactgataatagatacttttttgtccaaagtttttctttcacgactattttcctactcgtttagcattatcagaatttggatcccaacgttctgcctttaaatccatattatctaatgctctttttatatttttcaaatcaacctcatctaaaataactttgctggctttaatattttcttcaatccgacttagctttcgacttcctggaataggtacgatccaatcaccttgagccattacccaagctaaagcgatttgagctggagttacctgtttttcttttgctaacttcttgatcaattcaactagtacttgatttattgccatattctcttttttaaatcgtggttgtttacttctagtatcatttttagaaaaagtttgattagggtcgatcgttgctgttaaaaatcctttacctaatggtgcaaatggaataaatcctattttcaattcctttaatgtatcaagtaatccatttttttcaggttctctaaaaatcatcgaatactcactctcaactactgtaagtgggcaaatagcatgagcttttcttattgtttcaacgcctgcttctgataatccccaatgctttatttttccttccgccatcaattctttcattgtttgagcaacaagctcaatcggtgttttaggatcaacacgatgtaaataatataaatccacataatctgtttttaaacgtttcagtgattctgataaagaagtgcgaattacttcaggacgtgcatctaaaacctgctttccatcaatcaccttgattccacacttagttgcgatctgataactatcacggggatagatactcaatgcctgtccaactaaatcttcattatataaaatttctcctgtttcactaacaccttgataacactctgcagtatcaaacattgtaattcctgcttgataagcaccgcgaattacttcaatcatttctttttgatcactcgcatcaccaaaaccatgggtcattcccatacatcctagaccaattgctgatatttcaaaattactaccgagttttcttgtttccattttctcttcctccaatatctttgataaatacatcctaatacttagagtcaactataagtcaatagttttaactaaaaaagaacaactcccttattcataaaattaatagattgtttttcgtaaaatacattattttactcgttttactaaatagatataaatgttgataaatttaagcaaataatcttgaaaaattaacatataatggtacaatacatacggtcttaaatatacaagctgattacagggggaaaagccaatgaaagcattttcacaaatgaacaataatgagttatgtgaattaaaaaaagaattagaaaagagatatcttgatttcaaagcaagagatttaaaattagatatgtcacgcggtaaaccagctagtgaacaattagatttatcactcggtttattaaaacaagaagattatatgattgatggtattgattgccgtaattatggtggccttgaaggtttaccagcaatgcgaagattctttggtgaattattagatgtaaatgagaaaaatgttattgtaggtggaacgtctagtctaacattgatgtatgactatcttagtcaagctatgttattcggtgtcatgggaaatactccatggtcaaagttagataaagtaaaatttttatgtccagttcctggatatgaccgtcactttgctttttgtgaacatttcggaattgagatgatcaatattccgatgaatagtgatggtcctgatattgagacaataaaaaaacatcttcaagatgaaagtgttaagggaatgttctgtgttcctaaatattctaatcctcaaggaatcacatatagtgatgatattattaaagcaattgccagtttaacaccagcagcaaaagattttagaattatatatgataatgcttactgtgttcatgatttgaatgagcatggcgatacccttttaaatatatttaacgaattgcctaaatatcagcatgaagatatggtcatcatggtcgcttcaacatcaaaaatcagttttgctggagcgggtgtatcatgtattgttgccagtgaaaataatattgtggacataaaaaaaagattaacgattcaatctatctcgcaagataaaatgaatcaattaaggcatttgaacttttttaaagatgttgctggtttaaaagctcatatgaaaaaacaagcagttttattaaaacctaaatttgattgtgtaatcgaacacttaaataatgaattaggcggtaaaggaattgcttcatggattgaaccaaatggcggatattttatcagtctcgatgtaatgcctggatgtgctaaacgaattggggaattatgtaaagatgctggtgtcgttttaacaactatcggagcaacttacccatatggaatcgacccacaagatactaacattagaattgctccatcatatccttcagttgatgaattatcaaaagccgctgaactactatgtatctgtgtgcaattagcttgtttagaaaaactattaaaataaacttagcgaaaggaaacttattcctttcgctttttatttcttaattttccaattacagccatcactattaatgtgagagcagtaataatatataaattccctaaaataaaatctaaaccattattatttacatgaatcattagatttggacaaataactgaaaaaattaaaaatactgtaccgaaaaataaaccttttactagactcgctgatacatcattttgatgacatgactctttaatattcatcttcatcaattctttttcatcaatactatcataatagaagattgcatcattattaaattcatcattagcgtaattattttcaaaatactgccatcccaaattttgatatttacgtttgattaatactaagtcattggaatcaacaatatagatacgttgcaaatcctttttctttttaaattttaatacatctaatcttaaaggttgaaaaagaccaaaaggaataatagtttccaaaatataattatgctgtacttttttatttaaatacttctctagttcctgacttcctaaataaagcttgatcctcatcatttcaatcattcctttcaattattagataatattgcattaactttaacaatctcattaaaatattcatctcgtgttagaccatgtcgatttaaaattttatcgatcttaccatctttcatatataacattttagttgaatacgatgcaacaaatgcatcgtgagtcaccataataattgttgtttgagaatcatggttgattttcgaaaataattccatcaattctctagaattattactatcaagattaccagttggttcatcagcaataattatttcaggtttactaattagggctcttgcaattgccgctcgctgctgttgcccaccagagcactcatatacatgtttatcgagtatgtccttaatacctaaaatctgtgtaacctgctctaaattttcctgccattctttttcaccgatactatttataattaacggaaaaagaatattttcacgaatcgttaaagaataaagtaaattataattttgaaaaataaaacctaactttttctttctaaattttgcctttgctgccccactcatcccaacaatacttgcacctgaaatattaacaattcctgaagttgctttatcaattgttgataaaatatttactaaggtcgtttttccagaaccagaaggccccataatacaaacaaattcattatttttaatttcaaaactaagatcatctaaagcaatttttggtgaaggacctagttcatcatatattttctttaaatttttaacttcaagcataatatttgtcatttttaatttcctcctttctttcatatagaataatcatttctgctaacatataaggaattagatattcagccataataataaaagttgtcattattcccattccctgattaaaataaaagacaataaaaatattaaaaatataaattattgacaatatccaaagatgacgaaaataatattttatttcctgcatataaacaaaatcaatttctgctcttgcaaagccaagttgatagatggcatgaaagtgttctcttctttgtatatgatcaattttaaaacgatttataagcgtcaaactcaataatatattggtaataacaaatgcaagatgcatctcaaaattgaacaaactattatcagtagtcccacaaatgaatggcacgattccgatcattgctaccattaagattaaaataaaagattttgactgttgcataatcaaacttacatcttctttaattaataggtcttttgccgttttgcagtactttaaagcatttctattatagtgatgtggtaaataatgccgaaacactccataggcaccgactgccccaaaaaatgaaaataagatatatccaccaacttgattatttccagtatacatacatattaagccaaatatataaataagaggataaatcccatccggcggttttattgcacgagtatcttttttataactaattatattatgattttcaagtaattctgttattccagtacgcataataaaaccactattaaataacataattaccaatatcatcgctaaaattactgctaatccctgcatcaaagcatcaaaactaaggacaaaaatatttgcatcaacacttaaaatttcatatatcaccattttaacaattggacttattcccaaaaaaactataattccaatcattgaagaaaaaaggacaatacataatacttgaaccaaactgtatatagttcgtttaaaaaagcttagccctgataagacagttaaccccatttctctagatttaagtctaataaaataattgcttgaatataccattaaaacgacacacataaagatcataaaaaacgttaataacgcattatataaaaattgaatatttaaaaaatctaaattaccactaatctctggtaattttaaaatttccataaataataaacaaacagttactgttgaagctatacaaatacataaatcaacagcactctttttttctaactttaataagtgcaatgccattttaatcatctttacaatctcctctttttattaactttgtaaaacacttattaatacttttgctagctcttttgaatatctcagtatatggtgtttttaaagctttaaattgttcatttacaagtttatcaatactatgctcattatcctttaattcttttaatggataaatataactctctttcataattgaaatataattctcacgaggattatctaaattatattcttgggaccaactgctaaaatgtttatttaaatatttatttaacattactggatcatttctatctcgataaattctaataagacctaatggatcattgatcggaacagataatgaaactatataattaaatagattatttatctgactattattcattatttgaaaagaatacgtatcactagtagtatgaatatcaagatcaacataataattcaaaaagaaatatgccttaccatcacacccctttgaactacacatcgataaatcaatctgcataatgtcattacaattaattttcacttcattaaaacaaaattcattttgattaatcaacagaccctcgtattcatgatttatagaattatcaaaaataacctctactttatgccgttgtatatatgctttaattttttcatcaatatcttttaactcaatttgtaattgttcaatatactcctgttttctttcaagtacatatctaattgaaagttcactattcattattagttttatctcatcaatggatatttccattgaacgtaatagtaagaccatttttaatgtatcaagatctttagatgaataattccgataattatttgcatctctttgacaaacaactaagccttctttttcataataaattagtgtttgtttagttatgccaaaaattacttcaacctcgtgtgttgtcataataaaacctcccttctacctaacatttaacactatatactaagaatacagtcaaggattatttatcaaacaactcaattaattgctttttaaaactatttccaattggtaatatagaaccatctaccagttctacgcaatttgcagcgattttaataacagcatgaagattaacagcataagatttatggatttgaataaaattttcatttttcatttggcagacaaactcgcttatattttttctttcaatatattcaccactattagcatgaatatgaatgtaatgtctaaaggattcaacataattaattgaacttattcttactttagaaatagttccgctattttgaatttgataagttttaaatctttttaccatgacatcaccaagctgactcatgagattatcaatatcttctataaatttattggttcgaatataattaaaggcttctaactcataacctttttttattagctctaaatcttctaaaccaatcaatacgatgatttgctgataatcctctaaacgaatcctctttaaattttcaatttcagcaatatttttaatttccatcatataaacatcataattaactgcttcttggtaatccatgatttgtagatcatcacataacttaagcagttctatttttaagatatttttgatatcttgattttttattgccattgcgatcctaatcatgatgaaccccgctttcaatttcatcgatatattgagataccatacgtttaggattagcaataacttctaataaattatatggatcattaagcgttattccaagagactcaatatgtttacaagccattacaaacttttgtgattctcttgtataaagtgcttctagttctacagtagtaccatctttcattgtaattgtaaaagttataggatgcccaattaaaccaaaaggaaatattggaacatcatgccaacctaaatcaatcctatccatctgttgaacttttaaagcgaggaaatagctattttgctgtttaggaagataaaaagctttgattctagctgtaaatttcctaaacgaactatatttaaatacctcttcatcgatactccaccacattccagagctataaattattggaccagcaataaaaaaattaataattaaaataacaaggcctaaaaaaattccattgacgattgaagcatggtattgaacttcaaatacaatcaacattgtcgcaaatggtacccatatcaacatattgacaatagctaaaatccttcgcggttttccgattacatattttttcacgtccatctcctcctaattttattttatctaattattattaaaatgatatacttatggcacgtattgagatttactggcacaaaaaaagattaatgattctgctcattaatctttaatacgattttttcgatattctaggaaatcattaaagaacatccgaattacacaaattaacggaactcctaaaaacattcccaagaatccaaagagactcccaaatatggtaattgagcaaataatccaaaatggtgatattcctacactatcgcctaaaatgcgcggtcctaaaatcaagccatcaaactgctgtaacgcaaaaatgaaaagagcagtccagattgctggcattatcccatttgttaataatacgataaaaactacgggcaccccacctatgaatggtccaaaataaggaatcatgttggtaataaaaacaacaaaagctaataatgggaaaaacggtaagcccatcagtccaaatccgactagtgcaatcaatccaataatgactgaatcaatgaatttcccataaataaaattaccaaaaatacgatgtgatttaatcgcataaccatgaattaaattcaaattttcttgactaataaaacaaagcataaaacgatcaaaaatacgtgcaagtttttctgcttcaatcaaaatatatggacaaaagatcaagcccatcaaaatagttaataacgtactccccgttttacctgcaaaagcaattacttccataaaatcatttgcgctaagacttttgatagaatcaacaaaagtctgctccacctggataatcgttccagctaaattaggatcttcaaaagaactatttatcgatgcttcaaaactcttaacatatgtatcaatatttttagcaaattctactgcataatccataaccataggaattaaccaggtcaacaacaaaataatcattaaaattactgccaagctcactaataaaacacttaatacacgtctatgctttttcaaaaatgagctttgacagttttcaaacagtttagtcaccatctgtactaacggctctaaaaaataggctagtaccccacctataataatcgggaagcacgcatttaataataccgaaaaccatgatggttcaaatactttataaacaactattaacaaaattccgattattaacagtccactatattgttttaatttatctttttgcatttataattctccttagatagttatcctaattataccataattatgcaggcatttcccctttttattccacttatccaaaagttgctctatatacgacaacgtcattacttcataaacctctttactaactagatcatataaatggaaatcatcattaataacaactaaagttagaccgtattcacttaatttttccaaaataaaaccctcctcaatgcagtttatgcattaaaagagggaatattactcatatacatgatcaaacttaaagaaagcattacaccgccaaatacatcactaaaataatggactcccaaatatatacgacttaatgtcacaaataatataattattatacatccgctgatcaacaacttgcgatatttcaacttactatgatacaaataataaataaataatccatatagacaagttattgccattgcatgtccactaggaaaactataattagtttcgttgactaaatgcacaacacttggtcgaggccgcttaacaataaactttataattcgattaagcagctgctggataaatgacgctgctaagcaaactagagcaattcttttactgattataaatgcaacacagattgctccaataatcccgataaaacttcctagatgagttaccataattacaattggtgttactctttcattaatcagtatttgcagcaattgataaacaaaattatcgattggtttaattattccagtcataattagaaaataatcaaggataaacaaagctaatgggattaaaaaaaaccactgtttataattcttttttaactttaacgccattttctttaactataaatgctggtaccccaacaactgtacaattatcagggacatcctttaacacaactgtttgagctccaataatactattattaccaatcgtaacatcaccaataacctttgctcctgctgaaaccatgacattattcaataacgttggatggcgctttactttgtgttcaccagttccaactccacctaaagtaacaccttgatataaaacacaatcatcacctatgatcgttgtttcaccaataactacccccataccatgatcaataaataaacgctttccaatagttgccccaggatgaatttcgattcccgtaaaaaatcttgcaatttggctaaacatccgtgctaaaaattttaaatgtaatttcttccacaaaaaactattgatccgataacaaaacattgcatgtaccccaggataattaataatcacatttaaggcatatctcgcagccggatccgtctctagtactttttttattaaactcctattttccatactctcactccttctagttaatatatcgataaatcatcaataatgcaactaatatatattatatttatgaaattttttattttttttctaggcaaaaattaaacagaactcatcccccatgagttctgtttaaacgttattagatactattatagtgtgtatctttcttcccctacataaatcattaattgatttataaatagattatagcttctataagaaaaatgtcaatataaatattgaaaaaatctaatttttttattattttttagtatattcataaactataaagtgaaaatcataaatttgtatacaattatacactattcaaataaaaaactgctattaagcagtttttaaattccatatagttttaaaataacattataagctttatcaataatatttttagataaacgaccttcaatcgagaataagcgtccatatgtagtttttcgaagttccttgtataatttaggcttggtatattttaaataactccacaaatcatctttatcttgaatactctcaggtgaaccatcatgagataaaagagcacaagttatcaaagtaatcattgatagatacttgatcatataatgacgttgcttacgagagcgcagtgtataaatatcataataatcaatatattcacgtgctgtatctaataatgcaggaataaaaatatcgttattaataacattttcaaatggattacggccaaaacagtataaaggcatgtcgatatagcaaaatgatctaatatatggaagaggagcgtaggcaaacatctccatataaaaagttgcatttagaggaaaattatcaatcacttctttaataatcttagtttttataattaatgccggtgttaataaatattgctgttttttaaaatgttttatttcatgccagccaaaaattttatcacttggcaaaagcgaacgatagcttactttgcgtggtctttttccataacaacaaaaataatcggttactaaaacatccagatttgcttgtactcgaataatatcttttaatgtttcaatgacccgtactaaagatgcctgatcaaaccagtcataactattcaagagtttaaaatataatccggtggtatactgataagcacatttaatatcatcgatattttcagtatttttaataactttaaaagtatcagggtattcattttgatattccattgctacttcataagtttcatcagttgaatttttatcaataataataacttctagttcatcttttaataataaacaggaacccaatgctttgtgcatatactcgattgcgttgtaacaaggaatacagatagttaataacttcataatagcctccatttatattcttagttatatcttagcatatttatggcataatatatagttgatattgcatttgggacgattttatggtattttatttaagtatacgttaaaggagaattgctatgtatttcgtaataaattgttttattagtgcagtatgtattatttctttaattttattcactgaagtctttcctaaatggactaaattattagttggtgccgtacaagttgttacaacttcttatgctattgctattctaattaaaaaaatcggtgaatggacttcggtatggtcaggagattataaatacattaatagtaatttcttatggatcctacctatcgttgctgtaattactattgcagttgcgtacatctgtaataaaaaatcaaaaaaagcagcaaaataaaaacatgaattcaaattcatgtttttattttatacctttttctttagcaattgcatctaatgttgctgccatccgagttaatgcttcgataacttgttgatcatcacgataaacacctaatacaatacgtagatgtcctgctccaccgggtccataattaattccatcattaaccgccactttagcttcactaataagacgcttacaaatcgcactactatcgcctaaagcgctaacatcaacccaggctaagaaaccagaggctggcaattccattgaaaccccaggtactgtatttaaaatattgtaagcttgatgacgacgaatatcgtaagcgcggttgaattcatccataaattcaggatgcttaaaagcttcaattgcagcaatttgactaacagtattagttgccccaatcacacttaccgcacaaccatacatcacatccataattacatcacttgccataatatagccaactcgataaccgcttaatcccatccctttagaaattgaacaaacggtaactgtatgttcaaacataccatctaaagccatcggtgcaataaactcattttcaaatgtaaaatcttcaaaagcctgatcacaaacaagtactaaatcatgttttaaaaccacttccctaattgccataagactttcatgattatagactgttgtagtcggattattaggatgagttaaaacaatcatcttagtcttgttactaactagtgattctaatgcttgttgattaatttgataatcttcagcttcatttaattcaagaactaccggcgtagcctgcatcattgtaatattttgcatattattaggataacttggacaaggaatgattacttcatcacccttttccaagaaaggatacattgcaaagaataaagcactatcacttccaggcgtaataattacgtttctagccggatttaaatctaccccatacattttcttggctttttgacaaatcattgccctaagctccatatttcccgttggagcagtgtaatgcgctgctacaggagattttattgcttcaagtgttttttccataatatgctcaggaattgaaaagtcaggcataaaaggatcggcccatcccattaatgctactccattttcagctaatttagcaaaactatcaccaacatccgctttttctacctcgctgaatagcccgccttcaaaccctaaaaactcttttttcattctatttttcatcttagtacctacttaataaaataaatatttttacgtcccggatgtaaataaattaatccatctcgagtaaatgctactgtttcttcagtatagaaataataatcttggccaaaagctttgctctttgtatttaattcaagtgcatatgttgtatcatatgacattaacacatcacctttaacaggaattgctttttgattattccataaaccaatcgttgtccctggcccatgaccataaatattacatggatgagaatataatacagcttcaattccttcatctttaccttgtttcaaagaatctatcaaaacatcattaccacttttaccatcagccatgttttcagccacaatgtcttgaaaacgatcattaaccttcattccatcaagcaattcctgtggaatactctcttcatcatctttagcaatataagccaatctttgagtatccgtacaaatattcaaatatttaattccaaaatcacaatgtaataaatcacctttttcaattacaccaaaatatcggggattatctaaaccaggtcgttgtaaatcaacagttggttcaaaccaataatctaatcctagatctttaacacgctgcatcatcaaccattgtaagtcctcacaagtagtaacccctggaataatactttttgaactaaaagcttcttcaatcacagaaaaagcaacctccataacttctggatgtaattctaattctaatggagtacgcaactccatcagcttaattgccaacatatcattacgtacgattcgttcagcatattctggagccatttttgctgtaatcatttcatataacccctgtgtcaatccatcactaaaagcaaaattatttgaaacattgactgcaattgtttgtggatcatattctttgcataaacgatttaaacaagccatttgatcttcattattaaaatcagtccaataacttgtataatatggcgctaattcctcacttggcatacagagagaaaaacgatgtatattatccccctctttaacaaaagcaaacaatgaaattcttcgtgcagttggataattagctggtgtaattgcatgaaataatggatcttcattatattctttagaagcactgatccacatatcaacatcatattctttcattactttaggtaaaataagttctaatcgttctttcaaacaagcatctttaatttgatattgttcttttactgatctaatctctttcatagtttcctcctagaaaaataaggtacacaaagtgtaccctattttatttcttatttttcaactttagcataagctaattgataatgtccttctggtgaatgagttacacctgttactttagaagacattaagtatggttcagcatatccaaataatggaattacataatgttgttcaccaactaaatagttttctgcagcatgtaaagcattcatacgttcagttttatcatcaattgcattagcagcagctactaattcttcgtatttagcatcatctactatgttacctggagtagttgaaccaatatacattgataaataagccattggatcgatgaagtcagcagtcatggcatgacgacagatttcgaaatcacctttgtcacgagcatcaaagaatgcttcaccttcagttgcacttaaagtaagatcaatataagcttctttcatagatgcttgcattgcttgagcaacgtttttatgcatagtgttatcattgtaagtatatgttaattttaacatattactttcactataacctttagaagtcatgatagcttttgcttcatctaagttataagtagctaatttttctacagcatcttgttcttcacggaagtcaccagttgctccaggaataccttttggaattaatccatttaattcataagcattgtcaccatatcctaatgcttttaaaacattagcacggttaattgataatccgattgcattacggatatcagcatcttttaattcttctcttgtattttcatcaccagcattgattaatacgtagtagttacatacaaaaggatcgattttccaagattgtttctttaattcatccttgctattgatagtatcaatgttacaagaagtagcgaaatctaaatcacctttttcaaacgcactagtttgtgcatccatatctgacattactttaaaagaaatagaatttaaagtaacatttttagcatcataatattcatcatttttttctaataacacttcatctttagtgtttacagaagttactttgaatgctccattgtaaggaacatcagaattgttaccccaagaagattttgtaatatcttcagcattttctttcaaataatcttctctaactggatagaatacagtgttagttaataaagaagtaaagtaagcacatttagattttaacttaatttgaatagttgtatcatctaaagcagttgctccaaagtcttttaattcatccatagtagtataaggagtgtcagtttctttacctgttttcttatcctttaccatatgagaagtaccatcaatatattgccaaataaattgtgtgtagtaaccaccagtagttaccgcacgtttccaagcatatacgaagtcagaagcttttactttttctccatcgctccatttagtatccccagaaatcttaattgtgtaagtaagaccatcttcactaatttcaggcatatcagttgctaaattagtaattacattaccatcagtatcaagtgtatataaaccttgataaacttgcgctaaaatgttagcagttactgaatcatcaacgattgcaggatctaagtcagcagtgtcttttcctactgcaactcgtaaatcggcttcacttccgccaccacaacctgttaaacaagttagagccattaagaagctaagaccataagctaatagttttttcatgttttttcccctttcaactatttctcatataagaaacatgccacttgacgatttccaactgtttttaaagctggtttctcttgtgcacatctctcagttgcctttggacagcgtgtcctgaagacgcatccactaggcggatttatcggacttggaagctcaccttccaatacgatacgttttttgttgcgtgctaccttaggatccggaataggtaccgaagataacagcgcttgagtatatggatgaagtggctcatgataaatatcatcagcatccccaatttcaaccatatttcccaaatacattaccccaatacgatcagaaatatgtttaaccatacttaaatcgtgggcgataaataaatatgcaattcccatttcattttgaatcttttcaagtaaattgataacctgtgcttgaatcgaaacatccaaagctgaaatcggttcatcacatacaataaactttggatttaatgcaagggttctcgcaattccaattctttgtctttgtcctcctgagaactcatgaggataacgacgaatgtgatctggtttcaaaccaacgatttctaataattcacgaactcttttttcgcgttcttcttttgtatcataaaccccatgaatatccattggttcacgaataatttccccaacagtcattcgtggatttaaacttgcatatggatcttgaaaaatcatctgcatatcacgacggaactcttttaatttagctcctttaatttttgtaatatcttcaccttcaaaaatgacttgcccttctgttggatcataaattttaaccaaagcacgtccagtagtacttttaccacatccagattctccaactaagccaaaagtttcaccaggagcaatctcaaaatccactccatcaactgcttttacaacttgttttttagctaagaatccaccagatactgggaaatgaactttaagtccttttacttttaaaattggttcactcattgtctattcccctttccttttcaaatatggattatttaaccagcatgagctgcagtgagtacttgaaaaattacgatactcatccatgtgatcaacacaaatattcattgcgttttcacaacgatcaaggaatggacatccttctgaaatatttaataaatcaggtggtgatccagggatcggatgtaattcttttttctctaaatcttcaggattggcaatacatgaaagtaatccttttgtatatggatgttgtggattatagaaaatttcatcagtagttccagtttctacaattttaccaccatacataatagcaatacgatcacaaatactagcaactactcctaaatcatgagtaatcatgataatacttgaatcgatttcatcttttaaacttccaatcaaatctaatacttgcgcctggattgtaacatctaacgctgttgtaggttcatcagcaatgattacttttggatcacacgctaaagcgattgcaatgatgattctttgacgcatcccaccagagaattgatgaggatattgacgaattcgatcttctggtgaaggaattcctactttacgcattaaatcaatcgctttatcacgtgcttctttttttgaaatttttggattatgattaataatcggttcaattaattgagtctcaattcttaatgtcggatttaagaaagtcattggatcttggaagatcattgccatatcattaccacgaattcgatccattgtttcttcatattttttacgactatcaaaatgagtcggtgctatttcttcaccatcaattttaattgacccattagttacactaccatttccagctagtaatcccataattgagaacattgtttgtgatttacctgaaccagattcaccaacaacacctaacacttcgcccttatctacataaaatgatacatcacgaacagctttaactgttccattttcggtactaaattcagtagtaaggtcatttacttctaacatcttcattctataattcccctcctacttcttcttagggtcaagggcatcccctaaaccatcaccaataaagtttaaagctaacatagttaaacagattgctaaaattggccatacaacctgtaatggctgtgaactgatcatcgcccgtgcatcattagctaaagtcccccagctggcttgtggagctgataaaccgatacctaagaatcctaatgttgcttcatagaaaattgcacttggaactaacattgtaaatgaaacaataattggtcccatactatttataatcaagtgttttaataaaattctttttttgctagctcctaaaacaaaggctgctaatgagaattcttgttcttttaaagtcattacttgagcccgtacttgtcgagccatccccatccatgaggaaatacagatcccaattatgatcgactggaaatttgaacccaatacaactgtaatcataattaagtataacatatctgggatagaatataaggcatcaacgatacgcatcataatcatatcgacttttccgccagcatatccagcgatagccccataagtaaccccaacacataaagaaataattgcggctgagaatccaactgcaagtgagatccgcccaccgtacataatcctaaccagtacatcacgaccaaagcggtcagtaccaaagatatgatccattgatggaccagcgaaagtattagccatattttgtccatcataagtgtatgatgagaaaattggcacaaagatacatccaattgccattaccaataaaaagcataacccaatcaatgctaatttatttttcttgaaacgattccaagcatctgcaatatatgttttactttcgtaagcgattttttcgctattctttttcgaatcatctaacttctcaaacatttctggagtaagttcgatgttcattaccttattttcttccatcttgcttcctcctattttaatttgattcgtggatctactactgctgatagtaaatcagtaataatattaaatgaaattaccaagaatcctaagaatattgttaatcccataatcattgaataatcacgagtttgaatacttgaaaccatttctcgtccaattcctggtactgagaatagagtttcaataacgaaacttcctgttaacatgtaggcaaacgcaggacctgcatatgtaataactggaatcaatgcattttttaacgcatgcttaataacgacctttttataaggtgttccttttgaccgcgctaagataatataatcttgacgcataacttcaagcatactacttctagttaaacgacataccatggcaattggataaaacgccaatgacaaggctggtaaaacataatgagccggtgaagtcagccccacaaatgggaacagcttcaatttaacccccagaacaatcattaaaagtaccccgatcaaaaatgatggtacagataccccgattgttgcaataaacatacaaagattgttaagccatttacgttttgataatgcagctgcagtacctagtgcaactccaatcactagtgctgaggcaaaagcaattgcacctagtctcgctgtaactgggaaactttgtgagattgttgtacctacatcacgtccaggacgaacaatactttcccctaaatcaccatgaatcaaatcattcatgtatagagtatattgctcaaatactggcttatctaaattgtactttttaatcgcaatttcgcgtgccgcttcatttttatatttttcaccactaattggcgaccctggtgttgccttcatcaaaaagaatgttgctgatgaaagtaagaacagtgttacgataccaatgagcacccgctttaaaacatacctaaacatttaatcacctattcctttactatatatctactaggataccttaatatgtatcaaatttcaaacatttttttacacgctaaccccatgagcccctagggattccgcccaaaaaccgcaaattgtatacgattatacacaatttgttggtattaaaatttttttataaataccatactttaattgatttctgcgataattataccaataatttattatcaagtcaataatttatttaattttgtattaaagcgcatacaatttaattttcagaataaatcccttttctcatacttttagcactatttgctgcctcaataatttcatttttataagtgtagtcatatccgtaatcatagaacttttcaactaaaccttcacgagcaatttgttcttgaagtaaatcaccatctacaaagacccatgctaataaacgcccatacttatctttactatcaccatctacatttaattccaattcgattttcgcagcattcgtcaattgtgtttttgtataatcgctcgcttctttaccatacggctctatctctttagttgattcaggtgtatcaatatataaaaaacgaacttttgtactctcaccatctacattgaaccatgctgtgtcaccatcaacacatctatctaaagttacttcaaatcgttcgcctgtgggaattgatttgttctgctgataaaaattgtaaccaattaccgccaagataactatgattccaagccatgatcttaataatttcttttgttgtgtttttgttagtttaatcttcttagccattaattccaaccgcctttttcgctaatacatcagctctttcattataaaaatcaccactatgggctaatactttgacaaatgcaatttttaaatcttgacgatactcttttactttacgctgatattcttgtgttcctggtttgtttgctttccacataccatttgcccatttttcaattccctcgtaatcaaaataaatacaaatttgtttataaccattgtttttagcaaattccattgcacaaatactgcctaaaatttcacccgcaacattacgcatcgaagcataattttcatcagcacctttaccatacatttctttgattactttttgttcctcaataatcacacatccaaaaccatattcatgtgtcttaatattgtagctgccatcaacataagcaattaaacccccatcaaattctatcttttcttctttaataaatacttttgcatcctctaatgaagtaaatgatttatatattgctcctttaaatttctcaacttgtttcttacattcatcccaagatgaataaattcctggtttgcgaccattttttactgcataatatttagccataacttctcctttaataattgataaaatgattttaaactagaaattctatttagtaaagaaacttaaagggtactaaagtaagaaaaattaatttccttagccctcaacagttgtctatttatcaataatgagtataattaatgtattaggttaaaggagaaataatatggatattgaagaaagatttttaaaatatgtaagcattgatacacaatcagatgaatactcagatactaccccttcaacgctgaaacaactagatttaggaaaagaattagttaaagaaatgttggaattaggaatcacagatgcacatttggatgaatacggtattgtttatggaacaattaaagggaatggtggtaccggggatatcatcggctttattgctcatatggatacttctccagatgctagcggaactaatattaaacctcaaaaaatcaataattatgatggttctatcatcgaaatcaataaagaattaggactttctttagaccctgaagaatttgttagtctaaagaaaatggttggtcatgatttaatcactactgacggtactactttattaggagctgatgataaagctggtgttgctatcattatggatttagcaaattatttgtatgaacatcctgaagtcaaacataatgatattaaaattgcttttactcctgatgaagaagtcgggcgtggagctgataatttcgatgttaataaatttggagccaaatatgcctatactttagatggtggggatattgaagaatataattatgaaaactttaatgcatatagtgctcaagttgaaataaccggaaaatcaatccacccgggaaatgccaaagataaaatggttagtgcaatcaatgttgcaattgaatttgaaaacatgctgccagctcagcaaaaagcatattttactgatggttatgatggtttcaatcatcttcaccatttagaaggtggttgtgaaaaagctactttagaatacatcattagaaatcacgatcttacattagccaaaaaacaaatcaatgattttaaacgtattaaaaaatatttagatgaaaaatatggatatgaattgatcaaactagatattaaagaatcatatttaaatatggcagaagttatcaaagaaaattattatataattgaaagattagaaaaagcaatgaatagtgttggaatccaaggttttgctagtcctatccgtggtggtaccgatggtgctcgcttaacatttatggggcttccttgcccaaacatcggcaccggcggtgataatttccatggtccatttgaatttgtttcactcacgatgatgaaacaatcagttgaaattttaaaagagctgattaaagagtagttttatgaaacgctgtttattcattattaatccgtcttcgggacaacggactattcaaaacactttagataaattaattgggcagcttactttgcgtcaattaattaatcatattgatgttttctacaccttaaaaaaagatgatgcttattttaaagcactaaatgctgacgaacaagactatgatttcattacagtagttggcggtgatggaacgatcaatgaagtagttagcgggatggttgccagcgataaaaaaattccactatgtatactggcagcgggaactgtcaatgacttcgcaaattatttgaacctacctagcaatatcgaaggagtttgtaatttaatcaataattttaagactgtctgttgcgatgtaggtaaaatcaacgaacgctattttatgaatgtggctgccgggggaatgttcagtgatgtatcattcaccgttagcaaagctgataaaaaaagattaggtcccttagcttactatctaaacggtattgctaatcttcctagtcaattaaatactaatattaatttaaaaattgttttagatgatgctaatattttagaaacagaagcaaaaatgtttatggttacaaatacaaatcgtgttggcggatttgaaaatattatcccttatgcagatattcaagatggaatgcttgatttaatcgtaataaaaaaatgttctgttactgatttagttgctctatcaaaagattatttgttgaaaaaacatgctaatagcccatttatttcttatgttcaagcaaaaaaaattgagatttacagccaacaaaaagttgtaattgatattgatggtgaagaggggtcaccattgccagtgacaattgaagcaataagccaagctatcaatattttagtaccataggagtttgttaaacagactccttttttattgtttgattatttaatttatattataatctatctgtacatcaaggaggaaattacatgcacccaaaatatcatttaacagcccctaaacattggatcaatgatcctatcgggtttatttattaccaaaataattatcatttattttatcagcattttccttatgaaaataagtggggaacaatgcactggggtcatgctactagtaaagacctagtaaactgggttgaccagggaattgcattataccctagtaaagactttgatgcaaatggttgtttttctggttcagcattagaagttgataaaaaaatgtatctatattatacgtctgttgtttatcaaaaagtcaatcccgaaaatattcataaaactgccccaggttatgatttttattctagccaaagtatgattataagcgatgatggatttaacttcgataatcttaatcaaaaacaattgatcattccagtatttaaagatggcgaagtcggtcatcctgttcatacacgtgatccaaaagtatggaaattccaagatacttactatatggttttagcaagtaagtatttagatgataacaatgattataatggtcaattattattttatacttctaaaaatgcaactgaatggcattatgctaataattatcgcggcattaaatgcggtgatatgtgggaatgcccagatatttttacagttgcccatcaggatatattgatcatgtctccagaacggactaatgatagcggctatccatctcacgcacgtattacaacagctaattttgatcatcaaaactgtcaattagagattactggtgaactaaattatcttgactatggtttagatatttatgctccccaaacaacgattgacgaagccggacgaagaatttatgtaggctggatgcgtatgcctgttgccgatgaagctaactggattggattaattacttatccacgtgtaatcacatatcaaaatgatgctatatttacgaatattcatccatctgtcgatagtctctttaaaaagcctgcaactgagtttaaagctacgcaggcatgcaagatcgtgactaatttaaaaacaggtgatttcataaatattggaggttatcttatcaagtatgacgattgtctttgtatcgatcgttctaatgtgtttaaatctgatgcggcattaaaagagctacgttcaccaaaaatcgatcactgtaatttaaacatctactatgaccaggatattattgaaatttatattaataatggtcaatatgttttatcaaatatcgtctatgaaatggcagatacgattaagagtaatactggttttgaaatctttactgactagaacttgttttaaacaggttcttttagtttaaaaataacttattatggcaaatattgctgatttaaaaccgttttatacttctgtgaccccaatttattaaattttcagaaaaactcctcaaattcaacaaaatcagtcatttaaggtaggtatattattataatcatttcaatattttatgaagacaactttgattaaaaaattattctttttaccaaaataataaaaggaattctcttgagaactcgcttttgcctttatctgctgggaattactattgcggcaataatataagcaataaagccactgcctcccatggcagagaaaataatccaacctaatcttaccaatgaaggatcaagatcaaagtattctgcaattccaccacatactccacaaaccatccgatcttgtcgtgatcgataaattcttttcatttcttacacctccatcttaattctaatacttccaacattacaatcagcttctattttacgttgaccgccactatgactatattcatcactcagtccgtcacttcgataacttccaatactaatatcaccaacatcactatcgacttcataactgtaatctgattcactacctaccattgttgcatcaatatctccagcatcgcagttaaattcacttcgataactattcaacaagttaatccgtgcatccccggcatcaacgtctactttagtatatgatgcaataatattttcggccttaaaacttccagcatccacatcaatttcaacatcattagccttcaaattaggaacaatcaattctccagcatctacttctaattcaaccttattaaattcatagctattcggtatataaattttaattctagttgttatatcggtaacatttataagatgccaaaatctaaaactatcctttacaatcaaagtgttttgttcttgatataatttaatttttttgctcacattttttgcttcaactttaattgtactaccttcatattcaattaattcaacagttccagcttctgcttgaatttccaaatttttaatgtctgtaaattcttttgttacatccatcgttttagtaataggtagactgattgtaaaatcacccttatcataaagagtttccagttctgaaaaaccaccaatcatcgtaccgctgatgaacaatacaattgcaagcaacaacgatcctaatgccacataccctatttttttcatcgccgatcacctaccctattaaatatattttgacaaaaatcaacgattcctctaataacagcagggattattttaatcaaacctttagctaaccagaaaaagacgaatgctaaagcaattaaagcacatcctgccgccatggtaatcaatcctgcgcctggatacgctgcaataatcataaatgctttgacaaagcagactatcgcaccaatcaaacaagcggctccaccacacaaaataccaactccaaggccaaatacagctccaaaaaaacctaatcctaaaccaagaatcccaccacctactggtaaagctagaaaaacagccccaataatgataaatattaataagattcgatttcggtcggaatttcctctaaaattattcttgtgacgtttattattttgataatcattattatcatcagcagctgtctcctcttcactaataattttagcatcaataatttcacgagattgtttataatttgaattatccatccctttttcactatactcaatatcctgatcaaactgattatctaaaccagctttaatgatcgctgcaacccgttcaggagagcctaaatcatttataacctgctgttcattttctggaccagcttcaccaaaataatcttcataatattgcatagcttcttctcgttcagcatcttcaatatcttgaagtaaaaatgctagttcttcaataaactttttacgattcataattatttccccccttcaataattttattgatcttacgcacatactcatgccattcccctttatacatctcaagttgagcttgtccttgtgacgttattttataataacgtcgatttctcccaccatactcttgatcatatgtttctaaacaattatcctttaataatcttcttaaaacaggatacaaggtcgattctgaaacatcaagagcaattctaacatcttgtgtaattttgtaaccataagttccctcggcctccttggaaactactgaaagaacaattgcatctagcaatgcagctcctgtattaaatatcataagcccagctcctttcatatttatctttcaataatattatattctatatagtattatctgtcaactaataatatataattattatatattataaaaaaagaaacatcatttgatgtttctcattagttacaggtatgtactccttccttaaatttctttaaagttcttgttatttctaacatacatatccaatatatgtataaataatttttcctctatcagtaatttcattgttctaaatgtctcatagctcaaataaaacgctataaccaacacgattcgcctccaaaacatcgcattgattctcaattgcccaaacttttaataacgctatccaatatttatcacatcccaagcgattactataattaagctgcttgtatatgaagccatttgaaaattctggagaattttagattataacaaataaaagcactaatatcttatccattctcaaaatttaatttcactgcccatctgataatattccgcttatttaaaataagatgtatttcatcgtaactgaataattccttttcatgatttacaatcatcaaattttaaaattatgacattgcaattttcatcaacgttttcccataggctattaacataaataaaattttatcactttgttaattattgttttttttaagatatttttcacatattcatttttaataatattttcaaggaggtaataatgaagaaggttaaaaatatattgattggactattagtatttagcattattgcgttatgctttatctttaacggtcccttagttaccgaggcctctagtgatgatgaaaatagtcgtccctatacacaattaaaaaataccactagtgatccggaaactatttacagtgataaatatcaaaaaaatatttatcagcaaattaaaaagattaaacaaataaataattacacttttaacaatcccttgttaattgaaaatccttatggaacaaacaccacaggaatctatatgtattttacaactgattctcaatgcgttgcgacatataccatcagttgcgaaggatacgaagacttcaccagaacacttaatactaatagtttaagcggcttttctaaagaacatgaatatttgctaatcggatctattcccgatgctaaaaacactattactgttacattaacggataccaatggcaaacaagttgattctattacgtggagctatcaagcacctaaattatcaggcggtgatcaatatctcagcgttgcaactgaaagttatgatactacatcagcgctaagcaacggtttatacaccgttttaggtaatgatgtaaccgaagaaaatgatgaacagacctatatgcgattatatgataacgatggcgtgattagaagtgaaattcctatcatttcataccgcagtcatcgaattttattcgaagataatactatgtatttaagtgtttcaagcacaaagatcgtaggagttgatcaaactggttatgtttcgacaatttattctactggtgattacaaattgcatcatgactatattttcgacagtcaaaataacttaattgttttagccagtaaaaagaatgcggtaactagtgaagataaaatcattatgattgatcataatactaaagctatcacagaacttgttgatttaattgaactctttccagattactataaaactaccgccaagccagattctgcagatgatttagattggatgcatatcaactcacttgaactagttggaaaagatagtttgatcattagttcacgagaaacttcaacaattatgaagttagataatatttatagtaatccaacagttgactatatgatcggttctaataatttctggcaagaaagtggttacgatgatttacttttgactaagacaagtgacttttcattgcaggcaggacagcactgtgttacctatgttgaagatgccactcttgccagcggacaatattatttatatctatataataataatctagcagtcagtacaactcgcagcgattataattggaaagaagatgataattatcaaaatgtttcttacgatactaaaaacggtatttcttattattataaatatttaattgatgaaaataaccgtactgtttctttggttaatacaatccccgttgattactctggttatgtaagcagtgtccaagaacttgataacaatattattattgatagcggaatggcaatgtcatggggcgaatatgatcaatttggtactttgatcaaaaaattcacaacaaccgggggcaaattcgtttatcgtgtctttaaatatgattataatgactattggtttcaataacccaatagtcattttttaatctatgtatagatatttatcatatttaatatactaattaatttaaataaaaagagcctaagctctttttatttatttttctaatgcctgttttgctaatgctagagcaccacacacaccagcattatcacctaaagcaggtgatacaatataatcatcaatcttatccgttaaaatttcatctttttgaatatatccatttaagaattctcttaaatatttatgaattaatgggaacatttgtttttgttttgagaccccaccacctaagatgattttctttggtgaaataactaaaacataagttgctagagcctgaccgatatagtaagcttctagatcccaagcaggatggtcagccggtaattcaaaaccttttttaccccaacgtgcttcaattgccggtcctgctgctaaaccttcaaaacacgtaccgtggaaaggacatttacctgcataagtatcgtcttcacgaacaatcatattcatgtgtcccatttctggatgtaataacccatgaactaaatttccttcaacaatagcaccacatccaattcctgtaccaattgtcatatacaaagcactgtctaaacctttggctgcaccaaaataagcttcacctaaagcagcaccattaacatcagtatcgaatcccataggaatatcataacgttcctttaaagcacccatgatattaaagttaccccatcctggttttggtgttgttgtaatatatccataagttggactgtttaaatctggatcgattggtccaaaacatccgactccaagtgcctcaatatcttttccatcaaaaaatttaaaaatattcgccattgtttcttctggagtttcagttgggaaagaatctctttctattacatttccaaattcatcaccaatacaaactacgaatttagttcctccagcttcaattgcacctaatttcatctattcttcctcctcatttttacatttccattatagcttaatttactatacaaatgaatagtttaagtgcaaaaacagaaacttttgacaagatgtttcataagttttcgtaaaatcatcaaattcatgaaactacgtttcatctaaaaaaatatagatagtattaaactatctatatttatccgtatgtaataatttattagcgttatcaatacgctcttgatttggtgggttaattccgtctaattgataaggaatccctagttcttcccatttaaatactcctagtgtatgataaggtaaaacttccactttcttaacattattcaaagtactaataaatttatctaattctgttaaatattcatctttatcactgatacccggtactaaaacatgacgaatccaaacaggtttatttatcgtacttaaatattttgccatatctaaaatattatcattaccttttcctgttaactcttgatgctgtgtactatcaatatgtttaaggtctactaataataaatctgtatatttcattaattcattaaatttagaaaaaaacggttcttctctagtaaaattaccaccactagtatcaatacaagtattgattccttcttttttcgctaatttaaataattcaattaaaaaatcaatttgtaataatggttcaccaccactaactgtaattccaccatcatttccccaatagctcttgtatttaagtgctttagcaattgcttcttgaggtgtcatttccattgtcgacttagcattagcccaagtatctggattatgacagaatttacagcgtaacgggcatccatgtagaaagattatatagcgtattcccggaccatcaactgaaccgaaactttcaatagaatgtacaaaacccttgattgctgtttccatgttaatctcctttttcattaaaacagcctcttttaattaagaggctgttgttatgcttatttttcaataactattacatagatttatggcaagttcttgaaataacatccatttgttgttcacgagttaaatcaatgaatttaactgcatatccagatacacggattgtgaagtttgcatattcttctttttctggatgttccatagcatcaattaatttttcagttccaaatacgtttacatttaagtgatgagcaccttgtgcaaagtatccatccattacttgaactaaattagttttacgttcttcttcatcatgacctaaagtatcagggctgattgtttgagtattagaaataccatctaatgcccattcgtatggtaatttagcaacggaatttaatgaagctaataaaccagattgttctgcaccgtaagaagggttagcacctggtgataatggttcaccagctttacgtccatcaggtaatgaaccagtagctttaccataaacaacattagaagtaattgttaagatagaagtagttggttctgaatcacggtaagtgtgatgttttttaagtttatttaagaattcttttaataaccatactgcaatatcatcagcacgatcatcatcgttaccataacgagggaagtctccttcaatttcgtaatcaattgcaataccatcttcatcacgaactgttttaactttcgcatatttaattgcacttaatgaatctactacatgagagaatccagcaataccagttgcaaatgtacgtcttacatctgtatcaattaaagccatttcagctgcttcataataatatttatcatgcatatattggattaagttaagtgtatttacataaatatcagctaaccattccatcatttggtcatatctttccattacttcttcgtaatctaaatattcagaagtgattggacgatattttggagctacttgagtttttgttttttcatcgataccaccattgatagcgtataataaacatttagctaagttagcacgagctccgaagaattgcatttctttaccagtttgagtcgcagatacacaacagcaaattgaataatcatcaccccatacaggacgcattacatcatcattttcatattgtactgagctagtatcaattgaaatcttagctgcatattttttgaaattttctggtaatgcagcagtatataatactgttaagtttggttctggtgaaggccccatgttttctaatgtgtgtaagaaacggaaatcatttttagtaaccatagaacgtccatcagttccaagtcctgcaacttctagtgtagcccatactgggtcaccagagaataattggttgtaagaaggaatacgagcgaatttaaccattctacatttcattactaaatgatcaattaattcttgagcttcagcttctgtgataattccagcttctaaatctctttcaagatagatgtctaagaatgttgatacacgtccaactgacatagcagcaccattttgagttttgatagcagctaaatatccgaaatataaccattgaactgcttctttagcatttttagctggttcagaaatatcgaaaccataagcttcagccattttcttcataccatttaatgctttaatttgttcagctaattcttcacgttgacggatagtatcatctctcattgatccacttccgcaatgtgctaaatcattttgtttttcttcaattaagaaatcaataccatataaagcaacacgacgataatcaccaacgatacgtccacgtccataagtatctggtaaacctgtgatgattttattacgacgagctaatctgatttctggtgtatatacatcgaaaactccttggttatgagttttatgatattctgtaaagatttttcctaattcaggatctggtgtatatccataagtttcacaagcttgttgtgccatcttgataccaccataaggcataaatgctctttttaaaggtttatcagtttgtaaccctacaactgcttctaaatctttaagttcttcgtcaatatatccagcaccataagcagttaatccagaaaccacatgagtttccatatctaatactccacctttagcgcgttcttctttttgaagttcttgtaatttaccccataatttatctgtagcttcagtaggtccagccaagaatgattcatcaccatcatatggcttgtagttattttggatgaagtcacgtacgttcacttcctctttccaaagtctacctttaaagccattccattgatctttttctaacatgtttctttcttcctccttgaaatttaataactgttagttaagtttcttacttaagttttaaataataatctgatggatttgcaagggatgtcatcaagactaatattctactactatcgtaatgcacttacataataagaataacacacactatattttggaaaataactttattttcctttgttatccacgactgcattatattataaattgtttttataattcaagtcatttgcaccaaaaaaacaaattattttcaacaaattttaatcattttttaagatataatgaaacagttgttttgttagcgcttacaaatactttttttaacttttaaagatttttattaataaatttaaaataaacgaatatattatattaccacgattttattatctatttaataaaataaaaatatttttacattaaaaattaaatctattaaatagtagatttttttttcaatttattatatagtaatatctagttgttaggagggtacaaaatggatttaacattcaacaccaatactgattttgatcaaacaaaagtactaattactaatatcattaaaaatactgctgatgactatgatttatttctttcagaaaattcaatcaataatctctcagtacatttaaccattgcaattatccggatcaaatcaaataattatattcccatgagtaacagtcaaatcgcttcatataaacaagatcatagttatccatatgcaaaaatgttatgcgaccgtttagcacgtgaatttgaaattgattttcctgaagctgagatttcattggtttccatgtatctatcaaaaaatcaaaaattagatttagaaataaattctggttttgatttacttgacgatcaagtttttaagattttaagagaaacaatgtatacaatttatcaagactatcataaagactttagaaatgatgataaattattcgttgctatcggtttacatttagaaccagctttagaacgtcttgcaaatggtcaacttgttgaaaatcctttaaaagaaaaaataatcgaacgtcatcaagaggaatttaattatagtaagattttaaatgatgttgttagacatgatttaaatctatcattcgatgatgatgaattagcttttatcgcattacattttgttgttgctaataatcgcatcgatgaataaaataaatatctaaataaaaatatcttcatttcgttgtgcttagtcagttttctaactaaacagtaataaatgaagatattttttatttatttaaaataaccaactcacttattcgtgttatgaattattatttttaaccaatttacatcccgcactagttccaattcttgtagctcctgcagctacaactttttccatgtcttcaattgtccgcactccaccagatgcctttacttctaaatcatctccaacagtttgtttcatcaaagaaacagcttcaggtgtagcccctcctgttgaaaaaccagtcgatgttttaacaaatgttgcttgagcttccttagctaatttacatactgtaacaatttcttcatcggtaagaagacaggtttcaataatcacttttacacatttacccgcagcagcatcaacaactgccttaatgtcattaaagactagatcggtattcccatcttttagtgctccaatgttaataaccatatcaatttcatcagcaccattagcaatagcatcctttgtttcaaacgctttaacggcacttgtattagctcctaaaggaaatccaatcacagtacatactttaacatcactatcagctagagcttgagcgcaataagctacccaggttggattaacacatactgaagcaaagttatactcttttgcttcatcaataattttagcaaccattgctttagttgcatcagcttttaatacagtgtggtcaatcattttattataattcatcttcatcttctcctttataatatattctttcaagtgcctctttaacaatttggctatcaccaggataatctacttgtcctacatcgagtgaaatgaacttttcatgtcccttaccaagaatcaaaatgatgtcatctttacaagctatctcgattgcctgttcaattgcaatttgacgtgactcgataattacactattaatatcgacaatttctttttgaatcgttttacaaatttcataaacatcttcaccacgatcatccaattgtgtcaaaataacatgatctaagtatcgattcgctaattgcccaagttccttacgtaatttgtaattacgcttcccaggagcccctaaaaccgcaataattcgcccatgcccttgtcgaactccatcaacatattcaaaaatagcttcataattactaatgtgttgacaataatcaataataactgcaaactgttgttctgtttgaatcagttccattcgcccttcgatcggttttacattttcaactgcatcaatgaccatcttatcatcacatcccatagcaatcaacacaccggttaaagccaagacattataaatattgaacattgcgattactggggaattaacatgaaaagtatttcctttaaatgaaatatcaaactcactatgatctaaatgtaattgaatatttttagccataatatcactttcaatttcaattccgtaagtcaaaatgcgtccttgggtattattttttaaagtcataaaatttaaatcatcactatttaaaatcgcccatcccgtcggtttaatcatttcaaataatttttgtttagctaaaacatattgttcctttgttccatggaaatctaaatgttcagccccaatattagtcattacagcaatattaaaattaatcccgtcaacacgtcctaaagccaaaccatgacttgatgcctccattgcaacaactttgaccccagctctattcatttcaaacaattttcgttgcaaatacagagcttctggagtggtataaggacattcctctttacggccattatattctaatgaaatcgttcctatatatccactactacaatattttgccatagcatctttaatcattgaagcaactaccgtcttaccactgctgccagtaactccgataattttcattttattacttggacaatcataaaaaagatttgaaacacgattaagttctactaaagtattctcaacccgaaaataaataatcttatcatggtaataattaagatctttggaatgaacgattacttttgcaccctgaaaaacagcatcttcaacataacgatgtccatcaacacttaaaccttcaatgcaaaagaaaatcgaataaggttttacatatcttgaatcactatgaattgaatagattttcatatcgttgtcagtatcaaacaattcatttaagcgtttcattaaacaacccttccttccaaaatttcatcatatttatcaattttgatcgttacgatctcaccaattaaattatcagctgttttaactttaacttttaaataatcaccagcatgaccaattaaatattctccatctcttttttcaaataaaacttttaaagtttttccaatctgttttaaagcaaactcatgatttagctctttcgataactgcaataaacgattagctcgttcatgcttaatttgatcatttacctgatctttcattttagctgctggcgtattttttcgtggtgaatatggaaaaacatgtaattcactataattaacttgtttaataaagttatatgtttcttcaaactcctcgtccgtttctccaggaaaaccaactattacatctgtcgtaaaagcaatatttggtaaataactgcgaatcttattaattttttctaaatattcagctgttgtatatttacgattcatccgcttcaaagtagcatcacttccagcttgtaaaggaacatgtaaatgatctacgataatctcatttgagccgattaaatcaataatttcatcactaatttgacttgtttcaatcgatgagattcttaatcgctttaagcctttgatcttcactaaatctactagcagttcataaaaactatagtcatctagatcctcaccataaccagctgtatgaattccagttaagacaatttcaacatatccattgtcaactagcctttgggcttggtttaacacactttctttttgtcttgaacgcaatcttcctctagcataaggaataatacaataagtacaaaaattattacatccatcttgaatttttaaaaatgcccgtgtatttttaaatcgatcaatatttagatcttcaaacttccttagattcattacattatcaactttaatgaccatttctccagtttccaaatgctcatcaacatatttgactatatcactacggtattgagttccaagaacaacaccaacaccttcgattttttcaatttcctccggggctgtctgactataacacccaactacacaaatagtcgctttagggttcttacgaattgccttgcgaatcatttgacgtgatttactatcacccgtatttgtaactgtacaagtattgataacataaacatcagcaacttgtttaaagtcaacttcttgatatcctgcttcattaaaaatcttcaacattgcgttggattcatatgtatttactttacatcctaatgtatgaaatgctactgtcttcatttactcaccttttttaatttctttattaattttttgtaggtcttatcaccaacaaatttattctcatataaaaactctaatatttcttcatcatcctgactattagctaatttaaccattgcttccttaatcaaattaagattagggtattcttttgtatatcgatcaattaaattaatttcatttgcaatacgataattttgtccattaaattgatataccgttttaaaatcatcatgataaaaataataactttcatcatcttgaccaaccagctgcaacgatgaaaattgtgaattgtatggttgtattccatataattcaataactttatctattgttttagcataactatttaaataaacttgatgttgttttagtgttactaattgataatcattagcataatatctgtttataaacggttctaaataaggaatataaattatttctccactttgatgatcttgaaaacttgggaaattattaattatcttttcttcatcatgattaaacatttttcttttttcttcataattcacatattcaaaaatatcataattagctgccataaatttattataacactcatcaatcgctatttttgtcctaattccatttaaaataacttcatatgcaaataaatcttccggtgtctttagtttataattaaagccttctcctgccagctctttattaccaccagtcacaaaattatataatcctgtcttatttaattttatttcataacgatatttatttaataaatccaatatactcattatccaatctccctagcataaccaattacacttaaaaaatataatggagctgtttcacttctcaaaattctttttcctagtgaacaagctttaattcctaatttattcatcatctcaatttcatcaagttcaaagccgccttcacttccaactacaatagtaattttatcacctgaagataattggtctaatgtttgttttagcaccatatgttcaccttgtttagcaagttcttcaaaagctactagattatgatcacctaaatattgatcaagctgttctagtttgattacattagtaatttctggaataaaattacgccatgactgttctgcagcctcttttaatatttttcgataacgagtgatttttttagcaaacttttgctcatccatctttactacacaacgctttgtttgaattggaacaatacgcttgacaccaagttctgtagctttttgtaatactaattcaaatttatcccctttgggtagagcataaactaaagttatctcgacatctaattcattattttcttcaagccgcttatcaattttaactaaacctatctcaatatcttcaattacgccataatatacttgtccagcattatctatacagataatttcatcaccatttatatttcgcattacctttttaacatgatgcaaatcatcatccggtaaaattagttgttgtttacttgttaaatcttcatttataaaatatcgttgcataatagacctccgctaacattctaacacgaattatcgacagagaaaagcaataaacgacatcactttttttacttttttcttctatttttatcagtattaatttagtaaattaaaaagttgatttccataagcaaaatgtagtgaactgaataagttggggcacaacttattcagttcactacaaatatcaccttttttaaattattattgtcccctattacaatttcacaacttgttaaaactcgatagtcactcgctacctattcacgtaactctggaattatttgtggtttggcatttttaccagttatttctgtttctttagcagaaatttttatcattgcattcttttccgtcataaatgatgacctatctgtttcattcgttactttagataataatttaactgtctgagtgtgaaattaccctttgccatctaatgatatcatagctctcttatcactccctcccaataaaaaaaccaaatataattttgcctaaaaacacaaaaatatatctggtcttacctcctcaaagcaacaatccttctatggtataaatataacacggaaatgaatattatcaatatttttagtgaaaccattaataaaaatataatccaatttcagtaaaatttcaaattaattttccaaatttttctacgattttatccaaaaaattatttccataatcataaaacttttgatgtttgtaagttcttttagaaaaagacttaccatactcatgatttaaacaataaccaaaatatattacactagaaattaaataaattgaaatcagcatgattactaagctggcaagcggcccatacaaagcattatatcgtgtataatgattgacaatatagaaaaagaatactccaattaaaacaatgcatgcactagtaaaagcagctccaatcaagccatatgataatggttttttttcaaatgataaatatcgataaaaacagtaaaatacaataaataaaccagccaacataacaattgtgctgttaattggtactaaataattaaataatgttaatcctactaaaccaattactaacaaaacaaaaactacgatagctttaattcgcactaaaatcgcataagtatcaaaaccttcatcagtcattgaaatcaacataaaagaataaaaagcattactcgctaaataaatagaaaatcccattgaaataatcaatgatacaaatgttgtatattcttgtgacattacatactcaacaaaaggtgctaaaattgtttcaggaacataatcatatagtaaattaattaaattaggcgcacttaaaatatccgtttgaaaaacctttaaaaaaataatcagtgccggcaataaagctaacaaaacacaaaaacttaacgaataacgaaacaagtttccctggggcgaaataaatttcattacaactctttgaaatctttccataatccaccatccctctttattgttaactatatcacaaaaatgcatacaaaaaaatagttaaaggtgttcaaagaacacctttaacttattgaatcgctaatttaaaatcatcatcaaagtcaactaatacatgacttccatttttaatatcacctttaatcatttcacgagcaaccaatgtttcgattcgtgactgaataaaacgttttagtggtcgtgcaccaaatgttacatcataaccttgttcactaattacagctttagctctatcacttactgtaatagtgatctttttatcacttaaacgatcagatagttgtttaataaatttatcaataattttattaacaaccgcttgatctaatgagttaaaataaacaatctcatcaatacgatttaagaattctggtttgaaatgtgctttcaattcattatcaaccgctgctcttgtatcactattattaccttctaataagtaatttgaaccgatatttgaagtcataatgataatcgtatttttaaagctgactagatttcctttagagtcagtaattcgaccatcatctaacacttgcaacaagatattaaatacttcgggatgtgctttttcaatttcatccaataaaacaatactataaggatgacgacgcacagcttctgttaattgtccaccttcttcatatccaacatatcctggtggcgctccaactaaacgagaaacactgaatttttccatgtattctgacatatcaattctaactatatttcgctctgtatcaaataattgctcagctaatgacttagctacttctgttttaccaactccagttggacctaagaataggaaacttccaattggacgattttcatcattgattcctgctcttgatcttaaaattgcatcactaactttttcaattgcttcatcttgaccgattacccgtacctttaacgcagtatctaactttaataatttttcacgttcagattccattaatttattcattggaattcctgtccagcgagcaattacttcgctaactgtatctacagtgaccttttcttgtaataagtcatcttcttttttagaagcttcaaattctttaatttctttttcgatttgtggtaatgtttgatatttgattcttgatgcttcttccaaattaccctctgtctgatatttatccgttaaagcttctaatcttactttttggtcttttaattttttaatatgatccaacgatttcttttcttcttgccatttgtcagttaaaccttttacttgttcgtctaaagaagcaatccgacttttaatctcatttaaacgtttttcattatcttcatttttgtcttctttttcaattgaaattcgttccatttctaatcgatttttctcacgtgttataacatctaactcttctggtaatgaatctatttccatacgaatagaagcacaagcttcatcgattagatcaattgctttatcaggtaagaaacggtcagttatatatcgttgtgacatattaacagcaccaataattgcactatcagtaatttgtactccatgatgtgattcaaatgaatctttcaaaccgcgaagaatggcaattgtatcatcttgatctggttcatcaacttgaactttttggaaacgtctttcaagggcagcatctttttcaatatacatccgatattcatctaatgttgttgctccaatacaatgcaactcaccacgagccaacattggctttaataagtttgcagcatccattgccccatcagttttaccagcaccaactaattggtggatttcatcgataaataagataatatctccttcagccttcttaatttcatttaaaacggctttcaatctttcttcaaattcaccacgatatttagctcctgcaactagtgctcctagatctaattcatatagtgttttattttgcagagaaactggcacgtcatttttaaagatacgccaagctaatccttcaactattgctgttttacccacaccaggttcaccaattaaaattgggttattttttgtttttcgtgataagatctgaatcacacgacgaatttcttcatctcgcccaataactggatcaagttttccatcggcaacatcttttgttaaatcacgtccatatttttccaatacttcgtattggttttcaggattttgattatcgaccatatttccacctcgcatttcatcaataattttctttacatttttcttatttaaattataaccatttaatatttcttttaaccagctactatttaattcaaataatgccataattaaatgttctacacttagatattcatctttaaaattatgcatttgcttatccgctaaactaagcagttgattcaaatcatatgagattcgaatactatttatatccacattacttacaatcggcttaccttgcaaccttacgttcaatttattttgtagatcggcaatattgacatttgccttacttaagactcgatataatatacctgcattgtcttccagcaaagctaatagaaaatgctctacatcaactacttgatgacccatttcactagccattgttattgctttttgaattgcttcttgcatcttggcagtccatttttcaatattcatgtctatcactcctttagcactctatatccctaagtgctaattatattatacatctccttttagcactgtcaaggttaaagtgctaaaaaattaaaatatttatttttaaatctacttctgtctagatgtaaaaaactagggtttgtcaccctagtttaatctaatatccaattattatttaccaaaatatctgtttaacaatccttcaaacgcttttccatgacgtgcttcatcacgcgccatttcatgcactgtatcatgaattgcatctaagtttaatgctttagctttcttagctaattctgttttacccatagttgctccattttcagcttcaacacgcatctctaggttcttttttgttgaatcagttactacttctcctaacaattctgcaaattttgctgcatgttcagcttcttcataagctgctttttcccaatataatccaatttctggatatccttcacgatgtgcaactcttgccattgctaaatacattcctacttctgagcattctccttcaaagtttgctcttaattcttttttgatctcttcatctacgtctttagcaacacctacaacgtgttctgctgcccaagtcatttcacctgtttgttcaacgaacttgtcagccccaactttacatactggacattgttctggagctgcatctccttcataaacatatccacatacagaacatacaaatttagccattataattatctcctttttatattatttatttcatcatcacctataattaacagtaatgattactgatattaatatatcatattttaattttttgtcaatatatatactcacctaaatagaaaaaaagctgaatttttattcagccttcttctaaaagagagagagaaatatatcgctattaacaattttcttttttacggtatagccataatccagcaatacttaacattcctaatactaagaatgatccaataactacatcgtcaccagtttttgaactagttgttgtatctgatgcagtgtttccattaattataccatcttcattaggggtaactgatggttttatttctaatgcatcaattgctgcttgcaacttagcctgtagtttatctacatcagtttgtagcatttctgaactatcttttaactctactttgatagttttaataatatccaataatttattataagattcttcagtatatctattagcatctagtgcttcagcagtttctaataaaatattaagatctgttaaatctcctcgttctacaagtttttcagcagcagctttcaaagtttttgttaattcagctatatcttcactgctgttttcatcatttaaagcatctttaacttctgttagtactttaacaaattctttccatgtagaagcagtataattattttctttataactatcaattaatccatttatagcattaatttcatcagcagttgcttttaaaaccaatgccgcacgtgtttcttgtaatgctgttaaagcatcttccaattgtttaactgtcgcatcatcactagcaattaggtcatgtgccacctttaatgcatctacaaatggtgttgcagtagatgttagatatttactagtatctaaattatccaactcatttgtatctatataattttgtaatacttctttactcactgaaacttttgtaattaagtttgatttagctacttgtaatatgttgaccatatcagcaacttctttaacgttcaattcttcttcacctttagctaataaagtattagcctcattaactttatcttgtaatgcctcccatgttgaatcagtataatcatcagcaactaatgcaccaattttatttaattcatctttaattaattgggcattaccacgagtaactaaattagtataagcaatttgtaattcactatatgctttgattattaatttcttatctcctgaagcagttgataaaacttcatttgcctgattcaatttgctaacatacttagcataagaagacgcagtataattattttcatcaacatttaatgagttaacatatttttgtaatgcttctaattctggtaaaaattcatcatcatttaatcttacaatttcagaaattgttgggatattatttgcttcccatacaatcttcaattcataagtcatatcaaatggtaaatatatctcatttagtgatttgcttaaagtgcctacttgtacccactgtttttcttcaccaaccattactaaagccattaccttagcattacttactgtccctttttgaacgatatttattttcttaacatctaaattatcagaaagtgtatatgtaatataccctgcatcagtagtatttggtttatatgctgtagttaaatcaccgtcaaacatattttgtggtacaaatccttgtacttccactgcatttgattcaaaagtaggatcatttgataccggaacatactcaccatcattaattacaatttcattgaataaaactgcacgattattatttgttgctgtcattaaaatttttaaataacgagccttaacattatcagcagtcccttcaaccaataccttattaggataagtacttgatgctttataacctgcatcagaatttatacaagtaacagaggcatcatttttattttctactccatcaccaattgttataacctttgtccaattttctaaatcattagaaataagaatatcagcatcccgaatataatttactgcagaatcttggcagaacatttgaattttagaaatatttctttcttgtcctaaatcataaataatgtattgtcctttttgtggcagatctgcaaattctgttgttgtatcaatattaccatcaaaagccgcaccattattacgactatcttctgctactccccatgaactattaattcccattgttgtttcatataatgaaggagcgtataattcatttgaatgtacttcaaatctattaagattaaaagtaatggcagaattagtattattaattattcttacataacgagcatcaggtaattcactagttttagtttttacagtagtccactcaagtgcatttttagatgtttctatagtcaaattatctttattcatatcaacaacaatttcactaatatctttaattcttaataaatcaacaccaatatattgaccttgagttaatgtgattacctcatcatacatcaatttagttaaatcttctttactttctgttatcaatctatattctgtatttgtgtatacatttgtatcatcataatctttaataggatcaaattgggcaacatcaaattctgagaaaattacccaagaatttttctgttcattatttactaaacgaacatatcttgcctctactccacgtaaattctcatcaataacatctttgccgttagtaacaccttcatatgatttatatgttgtccaatcttgaccatcagcagagtattgtaaactgtatttaagccacttgtcacccgcattacgatctccaccaataacagcatgaacttttcctatctgaattgtttttccaaaatcccaaccaataaaatcaccaacgcggctagtatcaccgggcttagtattaaaatctaaagctgtagtgttatctccatccgttagatttgactctgttcctttgtagacttcccatgtatcagtatacataaatgtcttttctatagctgcaggattgcttacactaaaatcataaactttccaccaaaaaccagcactatcattttgtaaatttaattctaaatttctaattctaactgctttaaccgttaagtttaatgctgaaacatcctcattaactgctgcttgaccatcatattttgcaatttcttgccaatttttaccatcaattgtatattcaagcgcatattttgtaattttatcagttttactatcttgaacaaaattaattgttcctaattttttaggatttttgaatgttaaaatcaatgaggcatcaataggtatataatctttaattgtgccacctttatacggatcttcagcaaagtgagcaaatgtagagttatctccatctgttacttttgcaagagtaccgccttgtaatgacaatttatctatagataatgttcccatatcattatctacaataggttcatctgttggatttacaacaatatcacgaattcctaaccaagtattagatttcgcttctgtggcaatcattctaattccttttacattttgtaattctaaatcttctaaaacaacttcatttggtagattataaatagttccatccaaatctttccattctttgccatcattagtaaattgcactttagattttgcaaaagtatctttagaattactatttgtacctaatctaaatatcactttatctacatcaatagcttttgtgtaactaacaccaacatatgtaccttcatttatagaatttggatttttataaacaatttccgtattggctttattatcaaaaacatttgaaatagctccagtaggtgtatcatcacgatttgtaataaattttgttacctgttttgatggatcaataattgatgatgcaacatcagataagtattgttccattgtttttataaacggtacaatatgttgtacccctacttccgcatattcatcatgatcaacataatggaaattatgtgtttttgatctttcaaaagcagcttgaccttgagcatacaagtcccaaatttggtcattttcagcaccatcttgcactgctttgacaccattaattaaagcaatcgctgcctcagtagtatcatcccagcaatctaaccaataaattatttgatcttttatacgagtgtcacctgcttcattacgataagtttttgcagctgtttgtaattttgtgaactcgttaattaaatcggtaaataaatcatcactgattgtattaccactatttaaagcagttttaaattgattcaaacgatcttttaattctactgactcttgtaatggcgttacacgactatccatattttgatttatcatatgttttgatagttcttttaaggcatccgaagcagctgttacttctgcgctattatgatcaacatatttaaatgaatcttcccaaatttcatctgcttcttcactagtttcccaaatattccatgaataacatgcatttccaaaaattgccactttacttggttcagattgttgcattggatttagaacaataccttggatcttatttggatcaacccccggatgtaagaatgtactatatccacccataatcaagtgctttttagaattatcagtacaaggccaattgatccacatatatggtccacgacctacattattagtaaaagttgttgtaaaattatttgaaacttcaccccaaacacgtccaccagtcataacaatttgaacgttttctgggaaattcgtatagtaaccttggccattacccatatattcttgagtacaaaatggtaatgttaattttaaatctggatatgttttttgcatttccttgatccatgcagtcatatctttcaaagttttaatgtagttatctccaccaacatttccagcatcatcagcaagaattgcaatttgacgaacacctgcttcaattacttgagcaaatttagcctgcattacttttaaatcagcttgataattttcttcactgttatatctaattgcattattcatatacggatgcaatgcaaaaacaaaacgacattttgattcattaccagcttgtgctaacggttttatttttgtttcaatttcttcatcactgtataattcacgccatttagaattatgtttagggtcatcttttggagcataaaaatatgaatttaatttataatatcctccccatttcatcaattcagagcgatcttctgttgaccaagggtttccataatatccttcaatgaatcctcgactagctacatcagcgtaatcttccattacaaagttacggattgaataactatccatctggttaaagatatgatataaactagtgattccataaaatgcagcatcagtatctttacctaatacagtaattgtcccattatctgaggctaataaatatgaatctaatttatcatataatccacttgtttttaatgtgtaatttttagatacatgtttatcaacgtatccatctgatcctttaatacctactaagatattagtttgatcttctttaatttcatttgagatagtagcatttatcttcttgattgccaatacctcattcattctagctttagtatattcatcaataccatcttcatatacaatattaatattttgatgaataacgtaatcaccactttgatattccatcaaatgtggtttaggataaatttcataatctgactcagcagcactaacttgtgttggccatgcactaaaacaaccgaaaaccattagtactgccaaaaacatagacatcagtttatgagtattttttttaatttttctcattatctccttttcctttcccgtatagttaatatcgagtcccattcccaaaaattatcaatattagttatacattatataaataaatcaatacagattttaaacaaaaataaagaccaaatataattatgctaaaaaacataatacatatttggtcttgcctgcttagagtaacaatccgtatttacaagtaaatattagcaaaatatttagtaaacgtcaagcgcttccattataattttgcgttcttttttatatgtatacataaataagtttgctcgtctggtgataattcataatcataacgatcacgaattaatttaacaatccgattaatacacagagacaatcgtaaatcttctttcaacatttcccggatatccgctgtagtatcttgcaattcatcaatttcatccctaaaaattctttccgctaaatactttaaatgagttgaaattcgcgcataacctagagaatcctcctctaagtcaactttcattgataatttaatcacatttagtacttcttttgtcaaagtaacaattttcgttgcattatttgccttattatcgagtgaaaagtttactaaatgtaaagcaatataacctgcttcgtcgtcatctaaccgtatccccgttttttcttctatataatcaagtgcccataaaccaactttatattcttttttatataatacttttgtttcactcaaaacaacattaggaagataaatctcttccttttttctttttactgcaaatgaaatatgatcacttatcgctaaaaatatttcaccactaaaatctgtatctaattccttattagcttgattaacaattttattagttatttcaaaatatatagcaggtactgtttcaatcgattgctcaaatcgtttctgctgatcatctttaaaaaaatatgtcttttcaatcctgctttcgtcaacttcatcaccaattctcttttgaaaaccgatccccgaaccagttaaaattatatcacctaactcatctgatattgctgcaacactattattattaaaaaccttgagtatcttcaatgttattgcctccatccatttacattaatatgtcattcatggcatcgacaataaattgtacttcggtgcctatgataatttgtaaattattttttccaatttttataattcctgttgctccagtagctaatatagcttgttcatcaactaaatcaggattacctaattccacacgtaatcgtgtaatacagctatctgcaaactgcacattatttcgcccccccaaagcttctatcaaaacaattgcaatctcatcatagtcttgattttctaatgtaatattgtattcctcttcctcaatttcaattatatcttcatcagtctcccgaccaggtgtcattaaattataacgaactatcataaatctaaaaatgcaataatatataaaagcacaaatcaatccaagtggaatcagcataaatatatcgttagagaacggggctttaatactcaaaatataatcaatcaatcctgccgaaaagccaaagcccgcaagccatttaaataccgcagccacaaatagcattattcctgttaatagagcatgaataaaatataatactggtgcaacaaacataaaagagaactccaatggttctgtaaccccagtaacaaatgaagcaaaagcagcagacaataaaatcgttccaacttgtttttttcgttcaggtctagcactttggtaaatagcgattgcagctgctggtaatccaaacatcattactggaaaaaaaccagcctgatacataccagttactcctttaatgcctccagacactgttccccaaaatttgccaatatcattaattcctgccacatcaaaccaaaagacagaattgagtgcatgatgtaatccagtaggaattaataatcgattaaaaaatccatataatccagctccaactggtcctaatttcgaaatcatttctccaaatgatacaaaacattcataaaaaaacggccaaacaattagtaataataaagaaataactagcattgaagcagtcgatattattgggacaaaacgctttccaccaaaaaaagataacgcatcaggtaactttactttcgaaaactttttataattatatgccactacaagacctgaaattattccaacaaatgcatttgcagaattttcaaaagcagcagaaacttctgcttcgggaattccttttatcaatgctacagccggtggtgaaagcagcctagaaacaatcatataagaaacaaccgcacttagagctaccgttaactctcgttcctgagacattccaatagcaattcctacagcaaataaaattggtaaattatcaataatcgctcccccagattcaatcaaaaaagcagcaatagcattattacttccccatcctgttgggtcgatccaataaccaattccctttaataatgcagcaattggcatcactgatacaggcaacatcaatgattttcccaatctttgcatgtatttcatcattcccatccccccaatcaatataggatttaactgtacctttccattcaatatatttatgtttctaaacacattgattattagtaaattaatgtgttttttttgtccgaacgaaaatgtactatttttcgtgcagaataatatatccaaacctattgtatcactaaagcgcttactttgtgttaaaaaaaatacaacgaactaagttcgcactatgtaagaaattataccttttattatcaaatcatgtcaatagatatatctgtggctatatacattaaatcataactacatattatcattttataaaataattggtataatataagaatatttaaagatattcttgacatataattatttagtcgatattataaatataacgatgttactattaaattaggcattagtgattattttttgatatcactaatgcctttttctatatttaaaaggagataatgaatgaatttttttactagactattaaaaaataaaaaaaatacagtatgtgctcctgcctgtggcaaagttattcgtctggaaaatatccccgacaaagcatttgctaacaaaatggtcggtgatggtcttgcaattgaaattaccgataataaacttgttgcaccatgtgagggaataattagtgttattgctaatactaaacacgcatttgttatgacccttcctaatggtcttcatttactagtacatattggtatcaatagagcaaagccagatgctaataattttcagtatcatgtaaaagccggtgactatgtttctttaggagcagatattgttacactaagcgataatttattaaaagtcctaaataataaggttattacccctattattgtttgcaactatgaatctcaccctattaaaacatttactactgcttcatctgttgaaactggtaaaaccatttttacttataaatgattgagtctaaattaaatgaagccccttatttggataaccaaataaggggcctcatttcaaaaattaggctcgttttttatttacagtataaaaagcgaaatttaaatttcgctttttaacatctattaaattattcctctttttttcttaacagccagtatataccaacaataacaacaacgcctaatcctgttacataggcaaaaatatttacatcatcacctgttttcgcagaatcactagcaggaagttcgtttggagtcggtgttggtattggggctactgttgctttttcttctaatttagcaaccgctgtttcaaaattgtttttagcctcaataaattctttagcagaaatatcacttaagttatcaagcatagcttttaaaacattatatgcctcttgatatattttagcagaactgtcagtgtatttgcttaaatccactaatgtaatactgttaatatattcttttacttcatcagctttagcacgaactacaagagctttaagtgcattatcaagtgctttgatactagcatcaatttcttcagcagttccattttctaatcttgcagttgcttcagcaattgcatcagctaatcctttgtaactgctagttgtatataattcttgattaactttattagctgtatctaaaatatcttttagatcaccaacaactactaatttttctttagcagcagctaattcactaatagctttcgcaaattcatcagggtgtacaggagtgctttgattatctataatcaactgttcaacttttgccttagcttctagatacattttccatgagttgattgtgtaaagtttttctggatttgtaaccgaagctacaaaatcattttctccttcaattgtaataattgcttcttcttgatttgaaggattaaatactaaattagtatttgctagatcataattagcaattaatttatcaacatctgcaactgaagtattatcaccattagcaattgccttattaattgcctcaatagctttactatatgctaaccatgaagccgcagtgtaattattttgatcagtatgtgcattagcgataattatttccaatttacttaaatcgccttttaatactttattttcaattgccttattaattgctctaacggcattatcaacagttgtttgtgaagcatactcactttcaagtacttgcttacctgcattataagcatctccatatgttgcagctgctgcagctgtccatgaagataaatcttccttgttatcaattaaagctttaagcgcatcaacattaagtgtagtgacctcagatttatatgttgataattctgtaatattaggaatcacatccccccactcaaccttaatatctaataagattgtattttcaggtaaaacaaattcattaattgcttgtgataatgttcctaaagttacccattgttctgcacttgcatttgtaaataatcttgctttaacaactgcattagaaattacagcactattttgaataattttaattgtgtttacttggttattagatgataaactatagttcacataaccattagcatctttaggaataaacattgttgaaatatccccatcaaccatataactaaataatccatctcttgtttcttgactactagatgtaaaggttggattgttttgtgaaggtataaattccccattatttatttctaattcttggaatctaacccatttatcagctccaactttagttctagtaatttcaaattttaaataacgagcttgcagatttaaaccatctactttttttgcattatatgaaatttcatgacttggtaaaacaaaaccaatttcatcagtattttcagcttcacctgggttattttcattttgattacctaaaagcatgatttctgtccaagtttcaccatcagtagaaactgagaactttccatgacgtggataatcccattcgctatcagtacatatagctttaaatgaatttaaagttatttcttgacctaaatcatatgtgaaatacttgccaacattttgtgatccctgataagcagtagccgtagtaagatcaccatcaaatacattcaatggtttatcgattgaaaaattactacttgtaattgatttctctttaatctcaactgtatttacaataaatttattaagatcaaaagttacttcagcctcattattattaataatacgaacataacgagcatcagcacttacattaccagcatttacgttttgccactcataactatttttagaaacttgaatggtcaaactatcatttgttaattcactaacaatatcttttaattcatgaattcgatctagttttaaacctacataatcaccattagctaaagtaatccctttagctggcgtaattttagcactttcatctaaataatcagcagttaaactcttatattcactaacattagtaaatactttaccattatgatataccttagctgctacatcaaattcacgcatagcaatccaagtgttttgattaaccttattaaccaatcggacatattgagcagtaatattttgatctgacaaatcagtcacaatattaattgtatttttatatgtttcaactgttgtccaagttttaccatctaatgaatattgtaaatcagcatctttaaaataatcaccatcgctatcagtgttaccttgaagaatattaatcttacctaaagtaattggtttagataatttaacccctacataatcacctggaatagttgtatttgcaggttcccctttttgtctaacattataatgtactttagtagttaaatcaccatcaataagattagcatcactaccaccataaatactccatccatccgtagtacggatcacttctttagtaaattgttcctcttctgccggttgtgtaacaacagtaaattcacgcattgccggccatttgtttccgccaccaacttcgctacatacataacgtacggcaacaacatcttcaatttcaatattagtaacatctacttgtgatgcatattcaccatatacttctttatttaaatctttaaaagttgttccatcagtagaatattgtaattttgcataaccaaaagtatcttcttttttatcactattattagcaccatttaaaatatgaacaccataaatagtcgttggtttacttagatccacttggaaatattgaccagctttttcatatccattatgccatgctgcagtatcattattaccatcaacaatatcagctattttacctgaatgccaagtagtaaagcttgatgaagcactaatttctaatggttgttctgtttctccactagcaatatagtcattaattggtcctgaaagtttatcttgtaaagcttttgccaaaggaatcaaatgtgttgatccaggactaactttagctgttccatttaataatttacggatatgattttgactattaattaattctgatgatgcatttgagaattgattaaaagctgtaaccatatcattttcttcaattgcaattgctgattctgtaaaatgtttaattgctgtcgctaaatcttttaaagaaccggtaaaagataataattcttttttcaggttttcatttttactatttgcatggaaaccatcacaagcatcaataatcacattcatttctgcaattaattgttttccactttcaataattgaatcaccattagctaacttagttttaaactcattaattaatggttgtaattcttcagattcagctaaaactaagccatgaccattaggttgaggattagacatatgcttagctaatgtatgtaattcctcacttgcctcttgatcaatatatttaaatgaatcagcccaactttgatcatcattaaagcttttaacattccatgcataatcagctaccgcaaaaatagccactttagaagcttcagcttcttgcattggattagttactaccccacttaaatcatcaatattaatatcagtgtgtaataaacttcctttccccatcattaaacgtgaaccgttaatatcattgacaggccagttcaaccagaacagtggacttcttctttcgtcagccccttctggtaatctgtttcttttaaaatgatctaatgttttttgttcaactggttgacacactgcttcaccagtccagaaaattttcacatcttcagggaatccagcatcataatcacttaattcagaataatccccttgccatgaatgattatatcctgctggacagaaaacagaatcataaacatctcctttttcttttgcccaagctgatacactattcatcattttaattacaacactacggtctaggctaccaacatcatcaccaagaacaccaaattggcgtaccccagcatcgtacaattgatcaaactttttaagtaatgaagcaatttcttcatctactttagatgtattgaaaccacccataaatggatgggctgtccatacaaatctacatttagaatcatttcctacttgaaccatttccttaatggctgcgagttcctcttcaggatataattcacgccataaatttttatgatatggatcatctttaggtgcaaatacataagaagtcattttgaaatcaccaccaaatttcattaatgacattctatcttcatttgaccaaggaatcccatagtacccttcgataaaaccacgaatatcggtatcagcataatctttaattacaaagttacggattgttgatccatccatttgattaaaaatatgttttaatgaggtaattccataaaatgccccatcagtatcttttcctaaaataacaatttcaccattatttgaagcaacaaaatgcgccccaaatttactaaatagactctcttcaacgctatagttggatttaacatagccatcaacataccctccagatttatatgtaccaactaaaatatttgtttttccgtctactttctgcttagatgtgctaatttgtttattttttgactctaatacttcagtcattctctttttagtagcagcatcaattccatcttcatataccacattaacttgtgaacgaataacataatccttatcttgataagtaatttcatgtggtgttggataaatttcataatttgtttctttagcttctacttttatatttggtgacataaaaaatagtgtactaaatacaaccaacattgctaatgaagattttaaagctttgtcccaaaatcttgccatcttttttcctccctaagatttagtcaaatggattagaaaaataaaagaccgatatacagaaaataatctgtacatcggtcttgcctaatctaatagtaacaatccatttacttcacgagtatatcatgacaattatcccctgtcaagaaagcgattacaaaaaatggatttatcaagcatcttttgatttaaccagaacgattggtttactatttgtgatagttgcaatttcacaacttacttgattggatacacataatggatcctgtcgttgtaaaaaatactgattcaatgggtactcagcaccatcaatatcaatataagcatcatctagtgcatataatgaaaaatacttatattcatcttgatacaccttatgtgttcccggcaataataattgaataacattttgctgatcaataattctaatttttttatctgcatatttttccaaaagacacataacgctaagaaaatgatctaaacgaccgcccgtcacaccataaatatctacttcatcataaccattctccaaagcatattctaaagctgcatgtgtatcggtcacatctttacgagttggcaatctttctatatctaactcacttaaaacattctcgttttcaatcgaatcaaaatcaccaattgcaaagacaggcttaatcccctgtttaagtaatatttcaacaccatgatcaacaccaatatattttaaactgtcatcgagtttacaagccagtgcactacaaatacctatcttcattttagtgactctattgctttcgtataatcatcactaccaaaaacatagctgccagccactaaaacgtcaactccagcatcattacataacttggaagtcgattcattgattcctccatctacttcaattaaataatgataattattttcttttctgagtgttgccagctgtgcaattttatcaacagctgccgaattaaatttttgcccaccaaaaccgggctcaactgacattactaaaacaacatctaactcattcaaaaatggttttagtacttctactggtgtatccggcttaattgatagcccgacctccacatcatgctccttaatatgagcgattaattcattaatcttatcttcagcaactgcttcataatgaaaaacaattaatgacgcattactattaataaaattatccacatatttagctggatcagtaatcattaaatgtacatcaagatacatatccgttactttactaacatcttttaaaatactatatccaaatgatatgtttggaacaaaatgtccatccattacatcataatgaatccaatctgccgctttgattgcgttaatctcttctttcaaataagcaaaattagctgataataatgaaggtgctactttaaccatacttccgttcctctttcttttttacatcttgtaaattcattaaataatgctcatagcgttctttagatatttttccatcttcaacggctttttttaccccacaattaggttcactatcgtgtaaacatcctctaaacttgcattcatgactaaattgagcaaaatcatgataggctacagctagttcttccggtgtcatttccaattctaatgaagaaaaaccaggtgtatctccaagatatccaccatacatcttgagcagttcaacatgacgagttgtatgttttcctcgcccaagagattttgatatctcatttgtttccaattttaaattaatatctaaggcattcaaaaaactacttttgcctaccccactttgtccagtaatcactgatactttatctttaaagactgtttttaattcctcaagcccatgattatcttttgagcttatttcatatacccgatatccagcctgacgataatctttaacatattgtttaacgcttttatcttcatctaaatccattttagaaataataataattggttcaattcctaaatgctcaattactaaaagaaatttatctaataatattgatgaaaaatcaggttccttacaagaactaacaatcagagcttgatcaacattacaaataggtggtcgaactaaacaattatgacgaggcaatacattcattacatagccatcattatcaccttcgacttcatattcaacaaagtcaccaaccaggggcttaatctcatccttacgaaatttccccctagcacgacattgaattatttgatgatcatcttcgacataataaaaccctgctaatgctttaataattcttccttgtgacatctctacctcctaatcatctgtaggtatttcaggtttataattataataataaagtgtaatagattcattcttcttagttaccgtagtaaaggcatctaaactttgacggactacttgatttacagtaatcttttcaatttcatttggatctgtaggtgttggcaatgtttcccgtttaactgaaaaacctttatttgttagtaaggtcgcagcagcatcaatatccattcctttaacatttggtacttcaattttaattcccgaagaaacagtcaatgtaattgtccgatctttttcatcaggatcaaccttatgcccttcttttaaactctgttcaacaactgttccaactgcttgttctgaactagtttctttgatcgtaacatcaaacccaagttttgtcagtgcttctttggccttattttgatccattcctacataattaccaagaactacataatcaccttttgatactgttaaaataattttacgatctttttcagttggatctactttagttcctttttcaatactttgatcaattacagttcctttagttttagaagatatctcatattcaatctctacttcaaatttcaatttttctaatgcctttttagcaacatcttctttttttccagtgtaatcttcaagaacaatatatttgcctttcgatactgttactttaacgacatcaccttctttgatcgtcgttccttttttagggtctgttgcaatgatttcacctttttcatattcatcagatagttcttcagtaatatcatcgctaatagtaacattatattcttttaaaatttcttttgcttgttcaactgttttttctgttaaatcaggcattagactagtatctggcttcactccaagataaatcgcaaaagcaattcccgcgataactaaagcagtaaccacaccaactgccaccttagcttttgtatctaaacctttaaatttattaactaatttactgaaaaaaccttcttttttaggggctgccacttctttttcttcaactggatctacgattggtgcagtattgccactagtaaatgcggaacgaggatcaataacaattgttggatcagtatcttggtcatgtgaaaaaactaatttttcttcatcctgacgctccatacaagtctttatatcatccaacatttctgttgcacttttataacgatcattaagatttttagcagtagctttaattacaatattctcaacagactggggaattgaaggattaaactccaacaatgatggtagatcttcctgcatatgctttaatgcaatattaactggtgattcaccattaaatggtacttctccccgtaacaactcataaaaaacaattcctaaagcatatacgtcactttgggcagtcgctttttcaccacgtgctaattctggagctaaataatgcaatgagcccataataacatctgtctgggttacctgcgctagagattgcattgaagcaattccaaaatcggcaattttagccactccactatcagtaaccaaaatattttgcggttttaaatcacgatggataatccctagctgatgagctttagaaattccactaattacttgtttcataatatcaattgcttcaactacatgaacagcaccacgctttaaaatcaactcttttaacgtcatacccggcacatattccatgacaatataatatttatcttcatcctcaccaacatcatatatttcaacaatatttttatgagaaagtgcagctgctgcactagcttcacgttgaaatctagttacatatattggatctttagcaaggctagttcgaagaatcttaatcgcaatagtacgatttaagataatatcttgagctaaataaacatctgccattccgccttgaccaattagttctaacaattcataacgttctgcaattatttttgccatcctatttttcctcccgattatcaatgatagctactccgatattatcacgtccaccattttcattagctcgatcaattaattcagtaactttttgagatacttttatattcttttttaaaatttctttaattatttcatcatttaagcaattatataatccatcactgcaaagcaacaataaactatctgcaaattctaattcgataaaagatggggttaattcagtatctgcaccaattgcctgagtcaaaacatttttttggctatgattaacagcttcttcttcactgattgctccacgatcaactaaagcattaactaaagtatgatctttagtcaattgcattaattgatcatttttcaaaacataagcacggctatcaccgacatgagaaatatatatcacattatccattaaaattgccacgacaattgtcgtacccataccatgatgctcaacattttgcttagccattctttttacaatcgcatcagcttcataaattgtttcatttacccattttttcaactcatcaacattatcaaatggggggatactgtcaaaacaattaacaaattgatccatcaccacccgagaagcaatttcaccagcacgatgaccacccataccatcacagacaattgcaataacttgatcttttacatttgcaataacagtagcctgatcctgatttttatttcgtactttaccgatatcagtcaatgcataatagttcattatttcaccccacttcttttagcccttaattgtccacaagcaccatcaatatcgcgcccatgttcttttcttaaagttacattaatatgtaatcttaatagctcatttttaaatatttctactgtttctttatcactaggttgataaccatgctcatcaacactattatatggtattaaattaacatatgcatttaatccacgtagatagtgtgccaattgacgagcgtaaacaatatcatcattaacaccttttaacatgatatattcaaaagtaacacgccgatttgttttatcaatatattcactgatagcttcacgtaaatcatccattggatgcaccttattgatcggcatcaattcatcgcgaatttcatcattagcagcatgtaacgaaatcgccaaattagtttgaattccttcttcactatattgcttgatccctttgatcaatccacaagttgaaatagtaatgtgtcgagcgccgatagctagaccatgtggatggttaatgatccgtacaaattccatcacattatcataattatcaaatggttcacccgtccccattacgactacatgactaactcgttgatcaatatcttgttgtactttaataatttgtgcaacaatttcacctggtgttaaatcacgttgtttgcgtaataaaccactagcacaaaatgtacatttcatgttgcagccaatttggctagttacacatagtgacttaccatagtcatgaatcattaagacagattcaatcaaacttccatctaataattcgaacagatatttaattgtcccatctcttgctacttgtttttctttaatttttaaaacatctaaagaaaattctactttcaattgatttcgtagatcttttgataaatccgacatatcatcaaaactacgagcatctttctggtaaagccagctaaaaacttgtttagcacggaatggcttttgtttgattgaagcaaaatattcagttagttgttctagtgaataatcataaatatttttcatcttattttcctttttctaatttacacatataaaatccatcactgtcataaacatacggtaaaatcttcttttcttcaattatcttcatatctggatatttatcaagaaattgttttatcatttgttcattttcttttttattgattgtacacgtactatagaccattttaccatttttcttcaataaatagtaggcattgtctaacaattttgcttgtaaaggaatgattgtatccattgcaccagaatcatgatatttaatctccggtttacgtttcattactcctaaaccgctgcaaggtgcatcaagcaaaattttatcaaatgattcttctgaatatttttctttcaacaaagtggcatccccaacatgcagttctacattattaacacctaagcgttttagattagcttcaactagcttgattttatgttcaaataaatcatatgcaattattttaccatgattattcataatagctgctaaatgtgtagttttacttcctggagcacaacacatatcaagaacgagatccgttggctgaggatccagcaacggagcaatcaactgacttgactcgtcttgaatagtgactaacccgtttttaaaataatcagtgttagcaatatttcctgctctgtacaagagtccatcgggagaaagattccctgcttcaaaattttcatcagttaataattgagcctttgtagtctttaaaatattgaccctcgctgctctggttggtggtgtattatcatgctgacaaatctttttggctatatttaaatcatactgtttacttaacatcttaactatccataagggatggcttgtttcaatagaaattcttttcaattcatccttctcatcaatctcacattttccattacgtaaaaaatttcttaaaatagcattaacaaatttccccgcaaaattatcacgtttctttgctaaacggacagcttcatcaattacagcataatccggaaccttatctaagaaaattaattgatacaatgacatcaataaaatcattttctcacgatttttaatttttttcccttgaatatatggcgccaattgatattcaagatataacttattttgaatcgttccatatacaattcgtgtagccaaatctttatcatttctagataataagcttttttctaaatagtcatttaaagtaatatttaaataactttgctcattttggtattttattaatacatctaatgcagtcgttcttgccataaatagtccttcctatatttgattatatggattaaagtcacaaaccacatgaactttatttccttttttattataaaaatcactcatcttttctaatactggatataattgtttactatttgtaaatttaatcataatacgtttacgataaatatcctgcatccgatagatcaaactatttgccggaccaagaattgccattttatcaagttgtttttgtaaatactcttttatttgcaccgcactttgattaacaacttcttcatcttttccttgtattaaaatgctcactaaatgaacatatggagggtaagctgctaattttcgtgttttcatttcttcctgataaaaacgaagatagtcgtgattcttgacacattgtaacacaaaatgctcaggattgtatgtctgaatcattactgtaccttctttttgaccacgtccacttcgtcctgaaacctgttcaagcagttgaaaagttcgctcattagcacgaaaatcagggatatttaaacttatatcagcatttaaaacaccaacaaaagtaacattttcaaaatctaatccttttgctatcatctgtgttcctaatagaatattaccctctttgcgagcaaacttatctaataatttttgatgcccatccttttgtttagttgtatcaacgtcataacgaatcacttttgcaccatcaaatatagtctccagctgttcctctactttttgtgttcctgctccaactaattttaatcgttcacttgaacaatgtggacaaagacgcggcatttcaatttgatgttcacaataatgacaacgtaatttgtgatccgccttatgatatgttaaggttacatcacaatgaggacatttaattacttcaccacaatcaaggcaacgaacatatgttgcataaccacgtttatttaatagaagaattacttgttcatcatgatccaggcaggtttgaatttgttccttcatcgcttttgaaaaaagtgaataatttttatttctaatttcatcagccatatcgatcaattcaatctttggtaagggaaactgattgatccgctttggtagctcgtatagatcataaattcctttttgtcctcgactataagattctagtgacggtgtagcactaccaagaataacgggacagttatggtattgcccccgaattcgagcaatctgagtcgtttgataccgtggcttgctttcctgtttataactaggatcatgttcttcatctaaaataatcaatcctattttttccaaaggcgcaaataccgcacttcgagcaccaacaacgatcttaacttcactattcaaaattcgccgatactcatcataacgctcaccagcagataattttgaatgtaaaattgctacctctttcccaaatttgtgtttaaaagcattgaccatcatcggtgttaaagaaatctccggtactaacattaagacagttttattatttctaatcacatatttagataaatgtagatacacttcggtttttccagaaccagtcacaccatgaattaaagcagtatgataagtatcaattttgctcatgattccattgactactttttgttgatcaacagttaaagaaaactcatgttcctctttttgatcatctaaataagggtcacgatataattcctgttcgattattaccgttaccctctgttcaattaacttgtcaagcagtccacggctataaggaaatgcttttagtggcgtgtcgggatgtgtttttaaatattgatacgcttcttgttgtttaacagttttaagagtagcatcttcattaataactttaattactttttgatacttaattccaacacttttatttgtacttggttttaattgaggtggcaacattgcttgaagacagctaattcgtggcgacaaagttaattttgctaatgtcaaagacagctcttgtaattcttgatttaataaggggcgctcatcaataacttcactaatatagcgatatttaaatcctgctgctgtttctaattcctcttttgttgaattgctataacgacatcccgttacatatccgattattcgttgatatccaaacgcaattgtcactctaaccccactagcaatttcagtatttgctaaataatcaaaagtagtgtcaagagcatgggttggatgttctactaatacttgtacaatatacaccatcatcatctccaatttgtttctattctaccacatctacaagataaaataaaagagtcgattaactcttatatctttatagcaaagtatttaattgctctcccacgttttttatttttggatgatctatcatcttaccacaaacatctgttctagcgaaaaattagcgagtaacaccgctggtaataaagtgcaaattaaactagcctgatgacactaaaagcttttattgatgattcatcaagatagatattaagatcatgtttcaacacataatcatgataaccatcaaaaacagttgcatgagttaatacatacttcattgcattcactctcttttaaaaaaaggaatctttgcgattcctagacacgataaatataattatcttttcgcggtttagcttctggtttcggttctttaccataacctaaaatacaattaccgattcctacatacttttcatcaatgccccactgctttaacaattcttttccctcagtactcataaaaacttctttggcacgatgaatccagcaagaatctacgccaactgcattggctgcatttaaaagattccccattactaacgcaccatcttctaaatatgttccaatcgttgaatcccctaaaacgactaccactgttggcgctccataaaaaggatcgttttcactatccattattgccgcattcaattttgatagccgcttaattatctcaggattttgaataactaccataattgcagattggcgtcccattcctgaggctgcatatgttccagccgtcaaaatttcattcaattgttcttcgctaatttgctctttttggaagcttcgaacacttcgacgtgtaattaaattattgattgtttcattcattatactatccccctttttataaggatattatatcacagacttaatgaatattaagatatagataattgtttttaagaaaaatactctatataatttagataaaaggagggctgtttatgtgtaaaaaactatcaataattttactatgcctgcttatgataacaggatgctctaaagacaagccaattttatatagcaatcttggtaatcaagccagtcaaaataaacttactaatattttaaatgaagctgacctccccaaagagaatattaaacaattcttttcctatgttaatacctttaatcagcacgctacacccttaattggtgattttgaaactttagaaagagaacaaccagattaccaatattttaaatataatagcccagttgaaataagtgatcaaaacgattctaattcactaattccttcatttatcttaataaaaaacctaatttatactaataatagcggtcacgcagatgactcatatattatgtttaatttaaatttaattgatactattgatcagtattcaatgagccaagaagatcgtttaaaattcattactacttttaacagcatttctgttaccggcataaaaaataatgaaatttctcatatcaatcaaattgaaaaaacatttagtgatcgtgactttagcgtaaaacaaaaccaaaaagcatcattgattaccttgtggcttcactcttccgcagataaccgtcgctttgttagccactgtggtgttttaattgatagcaatgatggtttatattttattgaaaaatacggttgtttttatccttatcaggtgacaaaatttaatagccgaagtgaattaaaaacgtatttattaactcgaaacgatctcaaaggagatgaaaatgacggtttgccactcgtttttgaaaataataaatatctgaataaataattaataatatcctttgaataaattgtaatacatttttatattagttcctagatgcagaaccacgactttaatccaacagtatgatttcggtgctgaagcactgaccatggcataatctaatttgaatttccgagcataatgatctgcctttcgtaaatgccagctgtttgtaacaactagagcatttttcaatccatttatctgcattatatcgcggctatacatcaaattatgatatgtacttcgagattgtccctcgataaggatatcttctttttttacccctaaactaattgcatatgaagccattattttcgcttcctgatattcatttttaactgccccaccagataagattaaaaatttaatcttatcttttttatataaagtaacacccatttcaacccgtgatttcataattgttgatggctcaccatcgatattagcgggataaccacaaataatcgcacaatcatattttttataacgctgttttttatatggttttttaaatactaataaaaatgctagtagattcaatattccaaatccaattattactcgtttgaccattttattacctcattattttacatttcccgggaaattgtaacaaaagggcctaatggccccgatgtttcgctttacgtttttgctgtttcaatacaaatagatgctctttttcagccgttcgctgctcacgacgaataattttattctttgccttattttgctcatattgtcgtttcaacgcttgcatcgatttagtacctgtttgtaagttcatagattgttttctaatcatccgttgtaatcgcttaggattttttggtttatctttatgtttcgctttgaactcagcaacaaaattaagtttatggtaattatttaaaaaataaacatatatctcaccatcacttggctcttgaccgaacacaactcgttcaacgtaacacttatctccatttgttaaataaaatactccaatccaaaacggatcatcaaataaaacatttaattccaaaccaacatccaacatatcgctatcctccttgaaatttacttctaagaacggacaacctcaggagggcaggttactgatgcaaaatgcacaacttgactaccaacaagttcgtgtttttatcttagcaaccatattataacttatttttcagatttatttaagaggaaagctattcctgctaaccctaaacctaatgcgattataataaataaattaatacttacatcattattcaaataaaaatatacttttaaatcatcatatagtcccatcaaaactgcaataattaataaaaaagctagtaaaaatggcacttttagccgtccatcattttttttcataaaatcaaacactttagcatcaaatactttaaatgcatctaacaacatgtatattcccaaaatagctaataacacaataatgtcggttgggcaaaaaattaaatcaagccctaatttaccttctaacccttgtgccaaatataaaattaaaaccattcctggataaaaaatatacgcaaacaccttaaaatactctttaaacttttccatttttcctcctactaaaaatcagggatatttacccctgatttgtttgatgattttttataatttcagcaattttatcttttgctgccataacgtcatcattttccactacatatttatattcatctttagtcgcaatttcttttcttgcttttgataaacgttgttggacaatctcttcttcctctgtacgacgtccacgaattcgtcgttcgagttcttctaagctaggtggtactaaaaagattgttgttgcatctggacatttttccattacttgaagggccccttgaacttcaatttctaaaacaacatttttaccttcatttaataattgatcaacgtaatctttgggtgttccgtaataattaccgacaaactgcgcccactctaataactttccttcttcaattttacttttaaattcttcttcttcaacaaaaaaataatcaattccatctctttcatttggacgtggttttcttgttgtcatcgaaatcgaataagcaagatttaaactatcgtctttgaataattcttctcttactgttcctttaccaacgccactaggcccactaagaattatcaacattcctttttgcactgtctacaccccttttttttgataagttcatcatacaaaatacgtcttatattgtcaattgttttcaaactatataatgtcaattatttttaatctatgttatacttacaacggtgataaaaaatggcatatgatggaataatgatgcatcaagtaattgatgacttaaacaaaacaataactggtggtagaatcaacaaaatctaccaaatctcaaaatatgaattattgattcaagttcgtaataatcgaactaattacaagctgctgctctcctgccatccaatgtacgcaagaattcagctgactaatttagactatcctactccggaaagtccgaatcctttaacaatgttatttcgtaaacatcttgagggtggttatatcaaaaaaattgaacaaatcgaattagatcgaatttgtcattttctttttggctgtcataacgaatttggtgattacgttgaataccattgttatattgaaattatgggtaaacattctaatattattctttgcaatcaagataaaaaaattcttgattgtttaaaacgaattacccctaacattaatagtgaacgttttgtacaaccaggggcaatgtaccaattgccaccaatgaatcaaaataaagttgatcctttcactagtgattttattgaaaacaataatctaacaaaaatatatcaagggatgtctccaatcctatctaaagaaattctttatcgtcatgataatggtatagattttaaagagattatggatgaaataaaaaatagcgataccctttatataagtagagttgatgaaaaagaatattttcatttaattccattaactcatctaaatcagcaggcacagtcttattcattattcgatggtctggataaacattttaatttaatcgatcaaaaagaacgtataaaacaacaaacatcaaatcttttgaaatttattaataatgaatatcaaaaaaatgttactaaacttgcaaaattagaatcaactctagaagattcgaacaatagtgatgaatatcgaatcattggcgatcttttatactcaaacttacatttattaaaaaaaggaatgcgtcatattgaactagataattactatgatggttctaagattatggttgatttagatgaaaaacttgatcctaaaagtaatgctcaaaaatattataacaagtatcaaaaggcaaaaaattcaatcaatgttctgcatgagcagattgatttaaccaaaaaagaaattgaatattttgacagtcttttaacactaatggataatgcttcatactatgatgccctagaaataaaagaagaattagaaaatctaggatatttaaaaaagaaaaagaaaactaatacgatccgtaaaaataaaaaaccttcttttgagacatattatactaaagatggtattgaaatatgtattgggaagaataaccttcaaaatgattatctaacttttaaacatgctcatcgctatgatacctggtttcatgttaaagatatgcctggtagtcatgttgtcgttaaaggtgatcaattagatgaatatacgattcgattagctagtaatatcgctgcctattattcaaaagggaaaaacagtagtagtgttcctgtcaattatactttaataaaaacattgaaaaagcctcatggcgctaaacctgggcaagtaatcttagataattataaaactatttatattgatcctgatcaacattgcctcgatgaattacaaaaaaaatagatgcctgggcatctatcttttttagcggttacatccacatccgcttcctccgttattagcgttgttatacattccattaataacagagtcacctgtgttattagctgcgttaaatcctgtacctgctccgttaaatggagtagcgttagcagcacttgcgaatggatttccattactttgagtcatgaaagtacgttcataacgtggataataacgtgggtaataaacgatattattaatatggcgacattcgattgggcaaataattggttgttcaacatattgattagagcagcttgtacaaacttttcttggtgcaacgattggagtagcacggcagcagttcattccactgttacatcctccacatccgcagctgttgttacaaccacatcctgagttacaaaacatcatttccacctcctttaatatactatatgttcgattaaatttggtgctaaggcaaattacacagaaaggtctaaattatgaaattaatcaaatggaatactgttgaaaacattgaagcatatacaattactaaagaattaggcgatatgtcttataataacgaggacaaacaattgattctcaataatcgtaaacaattagccaaacttttaaaaactgatttagagcacatggtggcaccacatcaaacacactcagccaactttaaagaagtatctcttaaagacggtggcagaggtatgtactgccaagatgatgcctttaacaatactgatgctctttatacaaaagatactgatctctttttattatcatttcatgcagattgtaccccagtgttactatattgtcctaaaacaaaaataattgctgcaattcattctggttggctaggaacaactaaacaaattgtttcaaaagtcacaaaacatctaattgaaaatgaacattgtgatcctaaagagatgcttgcctatattggaccatgcatctgccaagattgtcttgaggtaatggataatgtcatcgacttagttaaacaaatggatttcgatactactccgtactataaacaaacagatactacacattatttgcttgataacaaaggtctaaaccgacaaatgttattaaatttaggtttattgaaaaaaaatattactgtttcgccatattgtactgttgaaaatgacaagttattttatagctatcgtaaatataaagatagtggcagaaatatcacaatcataaaaagacaagcttaaaggactataacaaataaagattttcaatctttgatatgttcccttctagatgacaagtttttattattttatttgtctacctaggaggaagcatatcactctaggcgttatagccctttttatttattaaatcagttttttctactttaattgttaatatttattttttagtaattaaattttccataaaattacataaattggttataaatcagttacaaaatcacattttaactacattaacttatctttttacttgttaatttttttatatgtttctcgatgaatgatataataaaagtaatatatataaacgataattgaggtgattttgtcgatgaatgaaaattttaattcagcattctacaagaagattcttgatcaaattaactctaatatctatgtcaccgatgttgaaactgatgaaattgtatatatgaacgattatatgaaaaatacgtttcaagtctctaacaccgaaggaaagaaatgctggcagattttacaatctggaatgaacaaaagatgtgagttttgtaaaatcaaacaacttcaagaatctaattcacaaaaaatttgtgtatggtatgaaaagaacacggtaacagaaaaaacatatttaaatcatgatactttagaactttgggataacaaactttatcatatccaaaattcgattgacgttactgaacaactacagttatctgtagaagcaacaattgatgaattaacaggtatttttaatcgaaatgccggtaaaaaacgaattgaagaactattaactgctgaatatcttaacgaagactttgttgtagttttatatgacatgaacggtttaaaatgggttaatgatacttatggacatcttgaaggcgatcgcctattaatatttgttgcccaaaatataaaaaagcgtttgaaagagccaaactttatctttcgccttagtggtgatgaatttataattgtttttttagatactactgttaaaggtgtagaagtttggatggataatattcttttaactttaaatcaagaaagaatcaaagaaaacattgattatgatacctcttttagttatggaattgctaatatccatgtagatgaaaatttaactgtttctgatgtattatctattgctgattcacaaatgtatatccaaaaacgagattatcatattcttatgaataaaaaaaggctaacaaattcacaacctaagtataattctattcctttatttgaatataatcgtgatcatctttttgaaagtttatcagaaacaattgatgactacttatttgttggaaatttaaagacaagtaaattcatgtactcacgtcagatgatgatagattttcgtttgccaaatcaaattcttgataatgctgcagcattttggggagaaaaaattcatcctgatgataaagcaggatttttaagaagtaatcaagaaattgctgatggcagagctgaacagcatacaatttattatcgtgcaaaagatgcctctaaccgttggattcccttgctttgtaaaggaaaaatgattagagataaaaatggtaatccagatttatttgctggaacaattcgtaatttagataaaaatagagaacaagcttctctagagccaaattctttagatacttatttagatacttcgtattatatttatgagaaaaatcaaagcaataaaaataattttctttttcaaaaaagcttttactttgtaaacatatttgatcagcaaaatgatttaaaaacaaaaactgacttacttgattttgtaaataaaaatatcccgggaggaatactagctgtccaagcgcactctggctttccactctattgctttaatcaagccattttagaatatacccaatattcttatgaagaattatgtcaaataacaaatggaaaattttcaaatattatctatgaaaaagatcgtcaatttgttgaaagagaaattttccaacagcttgaaagaaatgacatttatgaaattcgttatcgcatagtttgccacggaggccatttgctttgggtatatgaaagaggaaaatacgttatcgatgggcatggtcaaaaattaattttgtctttttttgttgatatttcccatgaaatgaataatgaacaagaactacgtttcattaatgaaaatagccttgacggagtttttaaagctgcattaattgaacattttccaattttatatgctaatgacggatattatcgaatacatgggtataccaaaaagcaatttcaccatgatttaaatgattgtgctgaaaatctcatttatgaatcagataaagcaagaataagagcccaaataacggatttaattaaaaataatcagtcacaagctattcttgaatatcgaattaaaaaacgagacaattcaattgcctggattcatattagtgccagctttacttcgctgcttgatcaaacaattattatgattggaatggtcatggatattactaaacgaaaaaaactagaagataagttatatcgctcacagcagttgtttaaagttgcacaaactaaaaccggcttaaatatttgggagtttgatattcaaaacaaacaagtaattggcaatcccgattctgcagtaatccgcagctatcaaaatcttactgccaatatcccagaaagcataattgcacaagggttgatccatcctcaaagcattaatgaacttaagaatttatatcaacgcttagaaaaaggagctgctcccctttctgctacaatcagggtcaaacaaaaagatgcgaaagataaatatctttgggaaaaaataacatatactattgtccagcatattgatgaaaaaccagcatgggcaattggcatatcagaagatgttacagaacaaaaaaaaattgagacaagaatctataatgaagaaagtttaaggaaagttttgaatgaagatattatattaaacatccgtttaaatttttctcgtgattttatcgaagatatttctttacattccaatgaacagtatgaaaaacagctctctgattacacatacgatgatatttataaatatttattacagactattgctaatgaggatgatcaaaaaaaatttgagaaaaaatattctaaaaatcaaattaatgactatatccgtacttttaccgatattccaacttttgaatttaggcagaaatatttaaatggaatgatattatgggtatccttaaatatgaaaacaactatttctcctcaaaataacgatgtaatattatttatttataccaaaaatattgatatccaaaaaagacgtgaattagcattgcaaaataaagcagaaattgatgagatgagtagcttatataatgagtctacttcacagctaatgattgaaacattgctgaagaaagaatatgatcctaagaaagtcaatgcttttcttttgctagatattgataattttaaacagataaatcacagtgggaatttcttgttcggtgaccaaatcattcgtcaaatgggacaaatgatcaagaaaagtatttcttccagctgtattgcagcacgaatcaatggtgatacattctctattttttatcataatgctgaatcaaaaaaagttatctatcaagcagccttacaacttcaaaaaaagctttctagtatttatcattttcaagatattgagacccagttaactctcaccggtggtttaatctatctattttcagaaaatatgagctatagtcaaattcatcaatgcgcactccatgccttagatacagctaaaagacgcggaaaaaaccagatactatcttatcaagaaattgaaaaagttgaatttaatttcaagattgaaatgattattaaccctaatgattttacaattttatcgatgagcccgactggacaaatcatatttaattgtattttcccagttaaaaagccaataaaatgttatgaattattacataatcgtaaatcaccgtgcccattttgttctcaacaaatcgactttgaacaaacaaatatgcgtgaatgttttgtatccaaaatcgataaacttatgtatgttaaagaacagctgtctcattatgagggcgatactgtaagaaaaattgaaatgcaggatattccctttaacttagcatatgaaaatcaggattcagatttacaacaatttttagaaataagctggaaaaatatagataaaaatattcaacgagaaaatgcttttgataatattcttagacaattaggaacattctttaatgcccaaaatgttctcttatttcatcaaagcgataatcaacaaaaattttctctgacttcaaagtggaattataataatcaaatctctaatattaaaaatactcatttcagtaaggaacactttgaaaatattgttagtgctgtcgcaccacaaaaatactttgtaatattagataaaaaccatttttgttataaaaatattacagaactatattttgaaaaggatgtaccactaccattattatttatcggcatttataacaaaaacaagcttgtatcatgcttgctcgtggaaactgttaaacaacatattaacgcttcaaaatctattgaggtgattgctgatgttatttgtaaaattaccactatttataatttgcagactaaatatacttatgcccttactcatgatcaaaaaaccggtttatctaactacgattcttatattaagactataagaaatataaatactgatatttattctacttttggaatgattgaaataactatcattaatctaaaaaaatataatcagcggtatggcatcgtccaaggtgatgaaatcttacagttcatcgcacaaacaattactaaattttttgataaaaaatcatgttatcggatcagtaatgcccattttatagtgctttgtccagatattacgtatgaaaacttcattcatatatatgatactttttaccaagagctaattgaattttatgatcaatggatcatttgtgaaaaagtttgggaaaagaattcacttgtgttagaaacaatgcaagagcaattagaggaaaaaacaagacatgctgtaaataaaaaaatacactctaagttagctaaatctgatcagtcgatagcaaaaatattagagcgtttaaatactgcttttgtaaatggaaaatttttaacctttttacaacctaaggctcatactaaaactaatcaaatttgtggtgctgaagcattgatcagatacaacgatcctcaaaaaggaattattccaccagggcgttttcttccagaaatagaaagagcaggattaattagacatatagatttatttattctaaaagatgtctgccgaattctcagtaactggttaaaaactacttggaagcctttcccaatttcaataaattattctcgagcaactattttagaacctggtattttagaagaaactaataaaatcgttgaaagctataatattcctaaagaattaattgaaatagaagttactgaatccattggatcaattgattctgctagtttaaaaaatattgttaatcaatttttagctgaaggatataaaattgctttagatgacttcggtgctgaatatagcaatatttatatactatactcgctgcacttaagctcacttaaacttgatcgaaagatcgtaagcgatatttatcatgatcaccgtgctaaattagtaatcaaaaatatcattaatacgtgtcaacaattagatataacttgtgtcgctgaaggagtagaaactaaagaacagctaaaagtgttaaaagatttatcttgtgatgttattcaaggctattatcttaataagcctttatctgaagatgatttcaaaaagatttctggcatcactaacccccattgacactaaaacaaagataatcctaagatagttttttagttctaaagcagatgagcataaaactaatttacgtgattatctttttttataaatgcatcatagttaaataccctgtatcaaaaaatttctattttattgattttaatacattcttttatcttgcttaaatactaattataaaagtcatcactattgatgactttttcacatatatttttaaatctattaaaattaaatttagatttcaagttctaattattcattgataatttcatgcattacttgtggaatcaaatcaattaatttactaggtaatactgtataagaattatcccctattacatccccacagctgccatgtagataagttcctaaaatagctgcatttttaggtgtatagccttgtccaacaaaactaacgatcatcccagctaaaacatctcccattccagccgtagccatcgccttattagctgtaatattacgatatgtctctcgaccatctgtaattaatgtgttaggaccctttaaaacaacagtaacaccatattttcgagcaaaaccaccaactttatcaatcatatctaattcatcatcataagcacacaaacgcttaaattcaccaaaatgaggtgttaagataataggaacggggcactcttttaataaatctaaatgtttagctgcaatcgtcaaaccatcagcatcaattacgattggacaattggcatattgtaaagtatcaattacatactgctcgctttgttcatttaaccctaaacctgaaccaatcaaaattgcatcacggtcataaaaaagttcttgttccagtttactattacgaagtttagaagtacattcaggagtaactgttgctagcgcatcaattactttttcacttgaacaaacacatacaacaccacttccactataaaccgaggcttttgacgctaataaagcagctcctcgatagtaatcacatccagttaaatgtaaaatcttgccatagattcctttatgtccataataagcacgcggttttaaatgatatttgatccatgatggactaaccaatttagcaagcccctgctcctgacgtaaatctttagcatccaatatttcaactgcaatctctcctgtatacatatgacactcttcatttaaaaaagcctgtttgattgctgttaaagtaattgtcttactagcacaaatcacattaccataaggtattcctgtatcaggatttaatccagttggaatatcaattgcgatgatgtctatatcatataaattattaatttcttcaattaatatcctagctactccacgaacttcaccatttaatccgaaaccaaacattgcatcaattaccacatctgctttttgtgcatcacttataaataaagatatatcttcttcatccataaaagtaattggaacttccatctcttgcgcttgctcaatataaaaattatttgcttgagaaaatttattagggttcccaaaacagtataacttcacatttcgtgctcgaatatgtagtttaatccctaaacttaaaccatcagctccattatttcccggtccacaaacaatcacgatattattataacccaaacaatgcggtaaaatggcattactagctttatccactagttcttcgattgaatatccctcatttaataaagcctgatcgtaagccttcatttgtctacttgttgcaacatacatattatcaccattactttctctataaaatcttatgtttatattataaagcaattattcataaaaacctacttagaagcaaaaaaaataaaaaaagcagatttctacactctgcttctaggacgctcatccattatctcttgataaatcattgtaacaatattatgtggattaatattttggtctaacagacgttccagcatgatcatcatttttccatcattaatagtaccgataatattcgctttttcaatattttgaatatcacatatatatggaaaaaattcattgatttttgtattgattccataatgatgattagaacggctatataaataaattatcttatcaccattacaatcctcaaaaacacttccgcgaggataattaaaaacatttttatactgcttaacttgctttcttttttgttcatgcttatattttcgtttattttcatatactatttcaatatgttttggtgatagcatattaaccagctcataagattttttacaatcaaatataatcgtttcactgtaatcaaattcatatcgtaatgctgcttcacgaacaaacttagtcttattaacatataagtttgaattatctgtttgataaatataatataattgatcacccactctaataatatcaccaacgcaataaataatcggaacatcaaaatgaatcaatccctctaggtagcgtgaattaacaatcagttttcgctcaatcattattaagttattaattccaatccgattgtaaatatctcgaaaattagttcgcggaatcttataagtgtttgttaaatagacatatgtatttttacgatggtcatatatattcttatcaagcttaaatgtagctaaataacgggacttttgttttgtagaacaataatacccataaaaataattttcgtccttagcaacgaccaaatagggcctaattcgatgactttcttctatacgttctaactcatcattacttaacggcatcaaagcccatactagatttcctatcgccacttcattatatttatcttcaacaattggcgtaagatctataatttcctctttttctagtctactaaaatactttaataatcttttaaacaatttcatcttcccaccccaagataattatatacccaacaatcaaagaatacaaaaagattatagaaacattaatcctataatctttttgttactcattatataattgaaaaaacgaactgaagtgaggggtacagttcgttctttctatatttatatcttatttttcagcaattgttgcataattagcaacaatgtaatctacaactggattacttccccaagttttaatagctgaagctgttgcttgaatcgtatttgcagttactgttaatttataattagcatcatcatatccgtacttacctttttcggtagttgtaatttctttttttgttccattttcatcagttgttacaaccgtagtaacactcttatcagttacatctaatagtggatttaaagtaacgttatctaataataaagctgaactattaccgcctttgattgctcccatataataataagttccttcatattcaacccatttacctgcttgtgccgccaactctatatcatcagtatatttcacaacatttggcaatgccaataaagccgcattttgtgttaaaccattttcatcagtaaatgtattgcttaaagtttcatcaccgcgggtccatgactctgttaatgttgctttaacaactacatcaacattaccactgttttttactgttacatctttatttacttcaactcctggtaaccaatcagttggtggagtaaattcttcttcaattgtagtatcatattttgctgttttaaattcatttgtttttgtcaattcctgactaaaatacgctaacgacccaactactcctactgttaatgctaataataatattccacctaaactttttttatttttcattcttcttcacctttccttttctttattgttgttcagcaatcgtagcaaaatgatcggctaaatacacagccatcacattatcaccaaacgcatccctaattgctgcttttgaagcttggactgtccgcgcttcaactgtcaaagtataatctgcgctatcatatccatattttccgtattgatattttttagttacagttgtagtcccttgttcatctgcttcaacgactgtatgactgccgctaactgttgcatctaataacggattcatcttcacactatttaataatccatttgatgcttcatcttcaccaattacacctaaatagtagtaataatcaccataatgaatccatttattatgataatctgctagattatctttaacatcttcatattcataaaccatattttgaacaaaatttttaattgccgcatcatgtgaaatgccgttttcatcaacgaatgaatttggtaaaatttcaccttcctcgctcaagattttatctggatcattaggatccatcagattttcactacgtttccatagctcagttaattttgctcttaccacaatatcaacgtttccagtatttttaactgtaacttttttattaatttcaacacctggtgcccacttatcagttggaataaattcttcttcgatcgttgtatcatactttgccgtcttaagtctattttcaacagttaagtctctagaaaagtaagccaatgtacctacaaccaatacaattgcagctaatgaaataagggcagataggcttttcttatttttcatttctatcactcactttctttttaatctaataatgcatacgtttcaggaactacagtttcaaaagcggttcctgcgactgcttgtttattagcttgataaacttgaactgtaatcgttaaagtatagttggcactagcatacttaccattaccagttacaactgttttattgtaagttgcattattgggaatgcctgtatttggggcaactgcccatcctgtttcaggattattagttattttgcttggttcaccagttgtcatcgtcgaataatatactactgttttcttagtttcagcaaaatcgacatctccacttaacatgattgattttaaaaacttatcctcggctctaccacccgaagaaattattccgtcataatagaaatatccatcactatttgaatatatccatttattaccatattctttttcaacaacactagctcttggatcagcacttgtaactgtaatatcttcaccatcagctgttttccatgtttcactccacattgctcgagaaacaatattaccagttccagtattttcaacacctacttctttagtaactttatctccgggttcccaattatcttttggtgtaaatttttccacaacttctgacttaaactgtccagtttttaatttgttatcaacattcgttgtgctattataataagcaactgccccacctataactaaaaatgctgataacgaaataattgcaatcaaactcttttttcgtttcataattttcgtacccctttctcaaatatttaataaccgatatgtggtattaataaccaacaaatatacttttgtcatattacaacattattataaataatcatggtttgcttctggttatatttataactcttattctattaatataactatcgaagaaaacttttcttttacaattaacagtatatctttatttggtttttttccggttatattcacaaacgaaaaataatattcaaaaacaaaaagagatgtataaaaatacatctctttcacgatttaatcaatagaaactaattgtccattttcaacaataattgaatcccaattttgcgtagcaactgcattagcaccgtcatctgcttgtacaccattagcagtgattataatcttagatttaagattagcatatgacattgtttcctcatgtgaggtaaaattattttcaataataaatgatttaaataaattgacagtctcattagattttaatggcatctttagatagtaataagatttacccttttccccagtagctttatatatccatttatcttcatcaattccacgaattacaattttatcaggatctttatcactcaagatatttccatcttcatccatccataccttttcaaccgtcactcttatgaaagcatctagttcctcagtattttttatatcaacaattttagatttttcttgtccaatcactactggatcatcatacttaattccatcttcactcacagaggcatcgggattagttgagctttcgataacatctattccaaattcaccaattctaatccggttcttagtctcatcactatctgtaaaccatgccagtgtggcggatacagcaagtacacaacctagcaaaactattagactcattatggttcttttctttttactcatctcgctacactcctatctttagactgtcactttttctttttcatccgctacaaggttactcaaaacaatatttaataacaatattccaccaataattgctaccgcaatatattttgctgatgaagcaaagatcgttccaacaacagggaggcagaattctaatgtctttccggctacattttgatattctaccggatttgtatcattagttggatttgcatcgccttttgtaacaaaagtttgtgaaatttcgtttttcactatcactcggtgagtaactaatgtatcatcatctactcgaaatgtgattgcatcgttttctttaatatcctcaaaagaagcagctttgtaatagatcaaacttccaactggatatgtgggttccatacttccagataatacaactacaggcttgtagccaactaccataggagcaagtataagcactaatgctattatcactacataacataatattgataaatagctaactactttcttaaatatcttcataacctgcctcctatcctagttattaaaaatcttctccagatttctgttgattactattacccttataatcactccatgttacattatttccagaaatagcagcagttttaccaaaggtgctttgtgccccttcagttgtagctttacatgattctaaattaaatgtaatttgatagattattcctgaataatccaccgcatgagtatcatttgaaacttgctccgataaaaccagactatccaaaatgatattagttgttgtattagcttttaatactttagtgtaatagaaatagccgtcatttccatccacccattcatcttgccaggcagatgtccatttcttttcaacactatcaacgtcaccatttacaaaatcaccattttgattgatccagctttgactgtaacttaccctgattaaagcatcaatttcaccactgttggcaaatttaacctttttatcaacggtttctcctggtaaaaattgtgaatcttgattaaatttttcaatcaattcaatctccggttcttgcgttgccattttgttttctacattgacggtactattatagtaagcacttgtatatccaatcgcaacaatcaaacatactgaagcaaagattaaagctaccttcgtctttttaatttttaaaaatttcactttatcttcacctccatttaattccaagtaattacattgttagaaataactttaaaatcacgaccaaagtttgcttgtactgctcgatggttaacactatcgtcatcactatactgtactgcttcactaacaaatttcaaagtataatctgctgtttgataaatttcggcataattgctatcaaatttaagactagttaaaactttagctgtcatttcattagctggaagaacttttttataataataccagccatcaccaccatcaaaccagtcattttgccatgcttcagtccagttcttattaacaacttcattgccatcaactaacccagaaataaccttgccatcagcatctttccaaaactccgcataagaaactcttagaaagactggtgctgttccagtatttttgaattgtacttctttttctacttgatcaaaccagtctacagttgaatctttgtcaaacttttctactacttcagtatccactgttggtgtcttaatattattagtgacagatgcacttagttttgaccatgcgtagattccgcccactgcagtaagacagactgtcaccactaccatcaataccatcaatggtcgtttcattttaattctacctaaatatttcattgcgtcatccctcaccttctttattaattaccaactttttttatttctgcagcttctaaatcagtagttacaccatccttataaccttgcacagttaactgtggttctcctgcatcagccacaatatttctaaatttaattccttcaattacaaattttccagtagtttcatcaataatatctttccattcaatataagcattagtaccactgccacctagcttaccaccttgagcatcaattacctcaaacttattagcatcatattttactcgaatatcaacatcggtatccattgttgtaatacttgtaaaaatactattaaatgcattttccatcgcactactgttatttgcttttgtataatgtccttcactagctaaacgcgttaagaaactatcaaataatgatgaattattggaattaagaccaatcgtaaaaatcgtcttacctaaacctttaccagaacgattagttctattgcctgcatcattagaattattgttactacgatttttagtaatatcatcatttttatgaccataatactttgatccattactactttcaatgtaattattgattcctgttaaatttccactaaacttaataaaatcagcttgatttaaagcctcagctccaacccgatacccattatcatcataatcattataactagtattaaatcccttatttcctggttgaccgtcagtaaagacgattactgaacgattattttctccagttgcacttgataattgattacgaacttcatacaaacctaaatcaatttgcgttcctcctgaagctttaatatttttgataccaccattatttttagttaaatatgtgtaccatgtttcattacctgatttaatatctgataacttcacaaaattattattagtgatcgaaccatctgcactatatgcaaaagtaattactgatacacgactgtcaggattatgttcatataacttagttataaatttaattacattattttttaaatgggttagacgactgctgccattcattgactcatccatgctgcctgatttatctaatagcaagacaacgtcttgtggggcttttactgtcgtagatttaacatttccacttacattatattcatagttattgattgtttcacttccagcaggaagataattagtcttttcatcagtcgctttaaagaatccaacatgaccaaatgaatttgttagagtcacataaccattagctgcatctttattttgactaagttcgataatatttccactagataagtttgtttgagcataaccactttctgtactttctagcttatattccattggaacagtttctgttacggtatatttaccaaacggtaaattttctaaaagaacttcttcattattttttaagattaaatctgttttataaattactgcattttcactatctcgaccaaccacatgaataataaatgtcttatcttcactagaattgtttacaaccttttttacagtaagagttgcacttgtaattggcaattcttcattaactgttggcacattgaaatccaatgtagaatctttatcaatataatttttatagactaactgggttgggtcattggctggataatctgtaccatccttatattcctctttaactgctacataatattctaaatgagcttgactgtttttttcaacatcacctacataccaagtgattttttttcgaccattttctgtacttacaataacataaccacgatcaaatattaatttatcagctacagagttatcataacggccatcaggtaaatctaaaagatcaacatactggctcattggatcattgacaatcccattttttatgattgtttcatatcgagtcacaatctcattagcaatattttcataaattccgcttaaatcactagaggaactataggcatatccttcaccttgagtagctacattcttcaagaaactattaacactacttccagttgtgtaaccaatcgtaaaaattgtatttccacttttctttgctaataatgcttcattttcagctaatgtagcagctgcattatttaaagaatagtgactattatttaaatataagtctaatgtaaaatcatttcttccgcccttaattacactatcataattgattgcattttccccaaaagtatatctaccactatatcctaaagctttatcagtagcggtcgcttcgctataatcattaactaaataaccattattgcgttcattatttagtttataacttcctgtcgcaccaccatcacttaataaaataataattccattttctgatttagcattttttaaaacagttctagctttataaagccctgcttgaatgttggttccaccatccgaattatttcctaattcgacatctctaattgcttgttttgcggtttcaagattgcttgttagattttgttctactgtaccatagtaattaaatgtcacaattgaatatcgattctttttatttccagaaattttactattattcaaaaactcaattgcagcgtttttagctttagtaagacgttttttatcatttgaagatgtgctatttccatgttcatcttcagccatactatttgaaatatcaaatactagaacaatatcattaccaatcgcctcaacactatcctgggcttttccagtagctaaatccaaattgattttataccgattatcgccaactctttctgaagttttattaacagtaactaggccatcactactagtagtagagccagggttattttccgcttcaacaattaagttagttccagccgctggtattatcatcgctaatgccaaaaccagtgtttttatctttctagtaaacttattttgttttctttttttagatatcttcatttagcttcctcctcactgacgttactgttaagcttcttttttgttaccagattaacgattatataaatcaacactagaccagccaaaattatttttgcaatcattgattggatcattccataaatatatcctatataaggaatatttatctttactatcccatttaatcgactaaaggcaactgggtttgaatcttggctactattagcatcacccttagtaataaatacttgtttttcttggtctattttaattactcggtgagttatcacattaccgcttacacctgagcctttaaaacttataatatcatttacctttatttcatcagctttagctggtttaactagtaataattctccagttgaataaacaggctccatactattcgataatacaacatttacctcataccccagcaatcttgggccaagtgttataatcaaatatataaagcataagatcaataatatcgttgaaacaatattattaatttttcttattttattcacttgcttgtttccttttaagaataaagataccagcagcaattaacagtaaaacaattccacctgtaatatacaaataagtataattaattccttcttcacctttttttaaaggcgtctgatcatcaggaacttcctctgttccatccccaggtgataacggagtttctgaatcagtcacattttcggtatcatcaccttggttagttgtagtaccaccagttcctgctccaccagttgcagttgatactgcagtgttagcaggtaaacctacaggaatcactacaacactttcaacatattcctgtgttacatttaaatctcgatatacatatgtgattgaattatctgtttcaccaattgtaattgataaatcagcagctccaatcaattcatagccagcaatcgttttagctctctcgttcactgtactgccaagtggcgctgtcataacttttgttgtggctatttgaacattatcctgattaacataattgatcgaatattcgcgtccattagtcaaaacttgatatttggctacaaatgtcattgcaccagtaacagcctcaccactagctggaagggttttattccatcccattaaataatagccatcttctacattgatatcagggatatccggaaaacgttcgtttgctgctacatcgatagtaatcttattttcaccattagcagcaaatgtaccatgagctcctgccctaaatgttactttataggttctactagcatcaactgtcattggattaacaaagccgaccattgcaatcatcatagctagaacaataatgacttttttaattttcttcatgactgcaatcctccttatgctttttcttcttcaataagaatataactgcaaatccactaactgctaccaatccaagtaatggtgcaattacagttgcatcaccagttttgatactttcataaacatttctaactacttcaacaatagtactttgatcatcaagttcttcaacactaaaattaaacttgatcaatccttcacgattttgatacgtattatccattgaatcaccattaacttccaatgtcattgttactgtagtagtttcacctttttgtaaactagcaagtaacgtatcttcactcattcttccagaacttaaagcagccagatcatcaagtgttccattataaaactcttcaccttcattagtaattgtaatattataaacacttaatcccgaagtatcagtatcaagactatctaagacatcagcactcaaataaaatcttaactctcgatgatcatcattttttaaaacaatattttgtgttcgaacttcaccaggcataatatttttaaaattatcaaataaatcctgactaccatccaaaaaaataaagtcttctgcatcaccatcaaatgatacattagtatcagctgcatgaatagtagtcatagatagtgctagtactgttgttacaactaatgtttttaaaatatttttacctcgcattttaatgacctcctccacgactattcttctacatactgaataacatcattattatcaattttaacttctaagccccattcactcaaaattgcagattcagcaccaactttttgaattgcttcagcttcaaaacttaaatgagcacttaaaccagagtaacgcattgcattagtgttatcgatattgccagataatttgatttgattaacaaataaatctgttactgcccctggttctaataattttttataatagaaataaacaacttctttattttcatcactatcttgaataatccaattatctttatcattagtaatgatttcaataaaaccaggattagcatcgatcaccttattaccgctttcatcttcccagtatttggtaacagcaattcttgtatataaatcattttctgatgtattttttacaaatgtttgtttatcttttatagctccaggataaccaaaattaaagttaataccttcatccgttatttgaccatcttcatttgttgtagcatctctcaattcaattccaatattccctgaactaagtttgttacttgaagaagtatcggcacggaaataggcaattgcgcctccaattggaaccatgatacatagaacaatcattaatattaatagcttattttttttattttccatgatgattatctcctttgctttaatattgatcggtggatacttttcccacattacatccatattatatgtaatggtggttttaaagcggttatattttgttttagataataactttcttttaaaatctaaaaaagagttaagttatatctctaaaacttaactctgaactgaagactctattggttttttatataataattttgcttttgcaacatcataattcaaacgatatgtagtactattatattttgcataaaactttttatttattctttgaatgattgtatatgcattgtccatttcctgacacgctactaaaataatatattgtttcttattaattttagcaaacaagtcattcactcttaatgatgaagcaatcatttcttttaactggttcattacatgtacttgattttctattgtagttttagcattaagatcaaaaataatcaaaaaatatttcttattatctcgaagtgcattcttaagtaaaatttcatacatatgcttaaacatgtcatatccacagtaaaaccctcgataatcagcattattaataatcaaatcttcattaacattttcagtattaataatataatcttcttctatatcttctgtaatgacatcataaagctctttaaaccgcggtgataatcctgttcccaactctttataaaagcgttcattcaggtcatcataatattttaacgcattatgatagtcctttaattcaatcaggcctttaatataataataatgtagaccttcgtaaaatggttctaatagaatagcatgataatttattgacatcatcttttcaaactgttttcttttcatgtagtatttgcaaattttgataacacagttaacatatgctgagcgaaaaaattctagcatctgttcaatccaaatagaatgattagtcgttatatataatttacctttatatagatgatttactttttgagcatatgctaggtccttatcacttatatcatcaatatattttattttgtcccagttataataaaactcctcagtatccatcacccattccaacttgggattgatttgataaccacctttaacagttaaaataacttcttcatcctcattaaaaatacctgatgcttttaaatctttacgaagtctaaaaatagaaaacttaaccacactatttggattttcactatccggatataaaatatcaataatattattcttagatattacaactcctttttgaagcagcaataattggaataaattaatcaactgttttcctaataatttggttaaatcaactgttacatttccacgtgaaagtgaaaacgttccaaacatatttacgttaatcttatcatttgccatatctaattccctcacttttcaagatatgttacttgcccacaaatttatccaccaaaatagtcatattctaaaaccccattacagtattagcccattatttttatttaatagtaatttattagtgataaattcttaccacttggtttaactatagattttcgtgcacaaaaaaaacacataaatttgggtctatttacgtgttttatagtaagattatatgcgaacgaaaacgtattctttcccgtgcaggaaaagtatgatcctcgattctaatttttttataaaaataacatattcattatagcactgtatttttaattacgtcaactttatttataagtgcggtaatactaattatattgatagaatcaaaaaagattacgaatttaaaatcgtaatctttaattagttgttatattcaatttttattttactcttacagcacaaacgaatcctgaaccagacacagatgaaatcttaactacatcaccagttcttggggcatgaatatattgaccattaccaatataaataccaacatgtcctgatttccataagatatctcctggctgtgcttgggaaatactaatttgtgtacctgcattcttttgagctgaagacgagtgtggaagtgaaattcctacacgtgagtaacaccatttgacaaaacctgaacagtcaaatgaatttggaccgtctgctccccatacatatggacaccctaatctagaataagcagctgataaaacactattaccatagttattacttgctgccccgccataaactgcatttacctttactgataagctcgcggtacctgtgttaccggctgcatcagttactgtatatgtagctgttttagtaccagctttcgctgtactaggagcatcaactttgacattggctttaacatcaccatctttgttatcaattgctgaagcaatatatgcattaaaatcaacattttcaccagcattaactgtaattgaagattttgttaaactaattacaggagctgataaatctttaacaacaacatttaagttagcctcactaacatttcctgaactatcagttgcagaaattttcaatgtttgcgtttcatcaatttttgaagtatcaatagatccttcaacagttggtactaaagtaccatctaagttatctgtaacatttacaaaattatttaaatcaaaaccacttccgtaatctacagtaacattttctccttgggttaaattaataaccggagcttctaaatcgctaacagcgaatgtaaaagttttaacagtttcattacctgaactatcagtagcctttaaagtaatatcttgttgacctttaacctctgtatttaatggggtattagcctcaataaatggagttacatcaccatcaacattatcattagccttaacatagctagcgaaatctgtacttccttttacaggaacatcaattgtgtatccttgatttgaacctaatgattcaaattttggtccctcattatctactacattaacttgaactgtttttgtagcaacattagaaccactatcagttgcagtaactgatactttataagaacctaattgtgttacatttaatgatgaagtgtcagctgatacttcaattaaatcacgactgtccttattatcagtaatatcaatactatctacatcaaatttctcaccataggcaagatcgatttgattagacttaatctcaggtttttctttgtctgctgctgcataaccaactagcataaaactagcaacagctgcaatcggaatgaacattgctttacgattaacgatatactcgtcaactacatttttaaagcttgtcttaatatttctatccattcgttacctcctttcaataatatatccaattgttattatattactattttttagaaaaatctagccctgaaagctctttcatttttgtcctttggctgtatcgcaagctccgcttagctttcaagagaataatttttttaagatttcttaagaaatttataagattttacatagtcctaaatagaaattaccataaacataaatattaataataatattatccagaatttataactaaaaataccttattcaatgctctttaatgactcaaccatatcaatattttttaaaacttttcgcattccaaaatcaattaaataagtaaagatcattgtaataattattgcataaacataactcattaaattaacacttctaataaacatagctacttcaacttctaccgcattaatgataaacatatgtaaaactttcccaattcctaatcctacaattgatccgattgctgataaaattaggttttctctaaatacataatcatacacctcacgtggataaaagcctaatacctttatagttgcaatttcacttttacgttcttgaatattaatatttgttagattatacaagacaataaaagctaaggccccagcacaagcaatcaatattacaacaacactatcgatactgcccatttgatctctaaatgcttgactaattcctttaacataatttaatgaatcaatattgctatccttgtcgcaatagttagtaacagttttacgattgccatcatcttctaaattaaaatacgcataattattaactggagtctcacctgttagacctcgataaaattcttcactcatatatatatggtgttgaaaatacaataacattactcctgtaattttaacctgataatctttttcatcaatcgttatatttattttatctccaatcgttactcctaataattctgataatttagctgaaataacaaccccctgattatttaatttaattttttcacctgtttgataattctctagatttgtatatttgctaagttcctcattattcttaaatacttctaatgtaccataatgatctttacttcctacaactgtgatcgtttttcgataaaaactactgcaatcttttacactacttaaactctcaaactcatccttttctttttttaattgatcattacttagattacgatcaaatacaaccattccatcgtaagtaaaaatatcaccatattgcttatctgctaaagtagaaaccgaattcttgatcccaaatccagtaacaattaaagccgcacaaccagcaattcctataatcgacataaagaaacgctttttatacctaaaaatatttcgcatcgtaactttttgattaaaagacaaacgtttccaaataaatgttattctttctagaacaattctttttcccattttaggggccttaggtctaagcagactagctggcatctcacttaattcttgacgtgtcactatgtaagtaactaataaagtaatcgctactgaaatcaaaaatgtttggatacaaataaaagtatcaaatgaaatcttgattggtgcaccgacattaaacaacattttacgatacaagaaataaataatacttgggaagaaatatactcctgcgataattcctaatacactagccacgaaagtagctaaaaaagcataaatcaaatattgattaattacatcttttttatcatatcctaaagctctgaaggttccgctttggactcgctgttcttcaaccattcgagtcattgttgttaaactaactaatgcagcgaccaagaaaaagatcagtggaaagactactgcaatggctttcattgattgacaagcagaatcatagcttaagatactagcactttcctcacgtgttaaactaatcagttttccagttggaatatcatcaatggcactgcgagcctcatccagttttatcttagcatcatctaacgatgttttcgcttcatctaatttaatctttgtttcatccagtaaaacttttgtcttgtctaatgtaattttagaatcgtccagttgttttttagaattagtcaaagttatcgctgtttcatctaactgggctttggagctgtctaaagtaactttcgtatttgctaacgtaattcttgcactttccaattgattagctgtagcagccaaaacagcaccattattgtccaattccagcttgctcgcatccaaagtttttttagttgcatccagttgaattttagtctcgttcaacttttcttgcattattgcagcatcttctggcgtaattaaattattctcaattaaatattgtaattgtactacactttgattatattgctcaattcccacattatactgattcagtccattattatattgatttatcccctcattatatgcactgattccttgatcatactgagcttttcccagctgataatcactgactccttgatcgtactgagcttttccatcttgatattgctttagaccattttgatattgacgatacccatcattgtatttatttaaaccatcttgatactgctttaagccactttcatattggctaagaccactgttatattgagctaatccatcttggtattcattgataccatcattatattcctgttcgcctttttctaattcacgattagcatcacccgctaattcctcattgacctgagcaactttaccactaagaacttttttaatttctttattaacatcttttacataccttaaataattatcactaaaaatattattatcatcactgttttttaaagtcactcgaatttcattaaaaacagttccattacgaagatcatatagatcttgcggtaaagctaatgattcattgccttgagctaaaatttcaacaaaagcctcattagttccatcaccgagagtatttgtcccccgttcaatcgtactaaaataacgaggatcattgatcaatccaacaaccttaaatttcttttcaccattatcattagttaatgttatcttacttcctactttgattttatttcttgaagcataattattatccaccaaacattcatcatcagcaactggaactgtaccatcaactaattcaattttattgaccttattatcaaaactctcatttgtatatactgtcgttcctttgacattatcaccaacttggatcaaagcatcaaagcgatttccatattcaacctgagcgacttgctcaatttttttaacagcttctatatcctcatttgtaaatcctagtgttgcaacgtaattaagatcattgaaagcgtgttcttgaagataactatccatcgttatttccataattgaagccgtatgccggagtcctgcaaaaaaggcagcacctaaaaagacaatacaaaaaatcgacaaaaaacgtgctttagttttttttattatttgaatttgattttttacatatgctctctttttcatattaccactcaatttccgcgattgacttaggatgttcgtttatattcattgaagctacttgaccatttttaagatgaatgattcgatctgccattggagctaaagcactattatgagtaataacaattactgtcattgtatatttatcgcacatctcccgtagtaatcctaaaatcgctttaccggtttgataatctaatgctcctgtcggttcatcacataaaagcagtttaggatttttagcaattgctcgcgcaatagccacccgctgctgctcaccacctgataactgagccggaaaattatctaaccgtttatttaatcctacacgttccaaaaccattctcacatctaaaggattcttcgatatctgggtagctaattcaacattttctaaagccgtcagattttgaaccaaattataaaattgaaaaacaaaaccaatatcatctcgtcgatattgcgtcaactgtctttcactatatttagcaacatcttgaccatcaactaaaatttgcccacttgttgctttatccattccccctaaaagattcaaaatagttgtttttccagcaccagaaggcccaacaattactacaaattcacctttattaacttcaaaatcaacaccatctgatgcattgatttcgacatcaccaactttatatgtctttttaacattattaaatgtaatgaaacttttcatttatcatcactacctttctaattaaaacatatacataattatatcacgaaactattctcaatccaatttctacttttttaataaacaaattaaataatgctactcatattacaagaatttttataaaaatcgtgctaaaattaaatcaattaggaggtctattatgaaaataatgattttatcagattctcattctgtttctaaaaccgatttattaacccttttaaaaaacaactctgttaactattacattcactgcggtgatatttatatgacttatgatggcatcaatcttaatagtttttatttagtccgtggtaataacgattttggtaatattcctgatgaattatttattacaatcgatgatttaaaattttatattgtccatggtcatcgctatgatgttgattataacctagattatttaacccatatcgcaaaagaaaagggagctgatatagtttgtttcgggcacactcatcgaccttattacgattttcatgaaggaatcacttttattaatcctggtagtgtttgttatcctagaggtcagtatcgtaatccaacttattgtatttttgatactaagacaaaaaaaagtactttttatgatgtcacgacattagaaccatgtgaccctttttccccaatggaacgtcctaaaagaaaagaaccattttataaaaaatggttcaaataatcggttccggcaaaactttttggtacatgagcgtacaaataatcatacaaactagcattgggataatttgaatcaataacaatccccccactagataaaaattaatcaatcctaaactatacaatttaattaaaataattatttgatacaacaaaggaataacaataattaaaccatagaagataatcatttccaaatcgattatcttttttaaatcttttagatcataccccatatgatacaagttaagaaagctcctttttcgtccttgcaattccattcctactttaaaaatagttgtaatcgataacaataccatgacactaaaatatgacatcaacgtaaccatactaatcaatggggtatctaaagtataaatagttgtacacatcaaaataatcgctgctatggttattactaaaacaagcattctaactttttctagatcatagcgaacatttcccagcgtaattaataaacagcggtcttctaacgattcattagtttgccgattttcaatgaattcaggaattatattcttaactaggccataaacaccaattattccaataagagcaatcaataaatgactagctgtatcattaagaaaaggaaatacgatcattggtaaaataaacaaaacaagatatattcgatttgatagtttctttacgcctattccaaatttttcaattttaacatttgcagtcaccatcttattgatgctggtacgataacaatatcccatatttaaaagcgtacaccagccaatttcacaaaataaaatgatagcagttgccataaaagtattactcgaaatataatttaaacttccttgataatcaaagaccataaaaagtaaattatttactaaaggaactagaggataactaatgacaaaaccaattggaatagctaaaaacatgataatcgtactctgtaaaagcaaataaatcccaacttgataaacagatgcccctgacatcaaaacaattgacacatctttagttttcgctaaaacataaaaatcattagccataaatacacaaaccattgcaatcaaaattacaaaagcagctatcgtagtaatcaactttgcatcattcccaccaagattgatccctgtactaggattaagtgtaagattaaagaataaaaagataaaaatcgttgttaaaacaaaagatagaaaataaaataaactctttaaaaaatcagtttttaaagatcttattgctaattttattaagcccattagtcaaacaacgcttgcgattctgtcgaattaatatcaacgattttgtaaaaatactctttttgactcatatcttttcgctctattgtttcatcaatcacaccatctttaatatataataatttcgatgaatacgaagcaattttagaatcatgagttaccattaaaatagatacaccgtcattaatatttaaatctctaaacaacgataacaattcatgagaatttttactatcaagatttccagttggttcatcagctacaataatctttggattagtaactaaagcccgacaaattgctgccctttgtctttgtcccccagaacactcacttggatatttattcaaaatctgctcgacatctaaccgttttgcaatctttgcaactgctgcttttatctctacttttgattttcctgctaacgtcagcggtacagcaatattttcaaaaatcgttagtgaatctaataaattaaattcttgaaaaataaatcctaaattttcatatctgaatttaccaatttctccctccgacatttgtcgtacctctttaccattaatataaacaaaacctttagttggaatatcgattgttgataaattgttaataaaagtcgatttaccagctcctgaaggacccatgacacaaacaaattctccctcatacatttctaaagaaacatcacttaacgcagtataggggttttttgtccctacaccatatatttttgttacatttttagcaactaaaattttattttccatcattttttcctccatgaatcggtgctaccaccgcttttttataattatagtaagtaattaaacctgaacaaacaacaggaataaagtagaccccaattactcctaacgcaaaagcaaccgacatctccccatgataaataaaacatcctgaaataataattatataaatcattggaattaataataaaactaaataaaaataaaatacctcatacttaattattttagttatttcttttcgtgtatacccaatcttccaaagattaaaaaataaagtttttcttgtctgggcctccatacaaaatttataaacgatactagttattaacaaaatgattattacaatgtaaccaatcactccagtaatatattcacgaggtgctccctgattagcagcgattgccgcaatcatccctgtaacagaaatcatcattaaactaattagtaaaatagctcgctgaattgaataaccaaggttagaaacataaatcaatgcatatctcttttctaataatttcttttctttaaacttcttaatatactctggcagcgcatatctaatcaaaccaatagccccaacgatccctaccccggtaggtgcaatataagcggtagcactatgctcattcataaacatcataactattccaaatacatataaaaataaataaacagctgatggaattactaatttacgtttatcactaaaatccattgccttttcttgttgtaacaaacttgaaatatcatttcgataaatatacccactagcaaaaacacaaagtgcaactaggatcattgcaactacaactatggtctgcataaatgctgctgaaggtatatgataaatcgatgcctcaatccccaaataatgaaacatccaataatttgagattggtgtaactgccatccccaacgcaagaccaattggtgctgcaatcagtaataatacaaatgtctgataaatcaaatatttagtagatttaaaagaactgtttcccgataatgtcataatggcaatttcattagtttttcgagaaataaaaaagctatttgcaaagaaaatcataaaacaacaaaagcaaattatgataaaagataatgttgtagaaagcggtacattgacttgattccatgtagcaccaccaacgacagcaccaggatcagctaataagtcgttattcataatattaaaaaagataaagcaaactgcaatagcaaaaaccattgtcaaagcataaaaagcactctttttatactctttcaccagtaatgtcattgcaaacttaaaatttcccatacttttctcctatctaagttttaaaaacttgattaattttattgatcaatttaaaaaaattagtcatttctgattcatctaaacatttagaaaataattgcactaattcctcttgtacctttctagtctgaactatcatatctttaccatgatctgtgattataacattggttattcgtcgatcagattcgcacgctttaaccttaacaagactacggccatgcattcgtgcaactattcctactgttgtagcatgtgagacatcaaattccatactaatatctttttgattgatcgttcgatcctgattatcggctaaaaaaatcaggacactaagctgtgtaaaagttaatccatatggctttaaacgagcatttgcataattagcaatatttcctgccagtttatttaaactgaacattacttcataatccttcatttccgcctccctaatatgtagcctgctacatattaatattataagatgactaatattaatagtcaattaaaatatgtagtaagctacatattctaattgactaaaaaaactataccttagtatagttttaatattcattcagctcttttttcaaatcttcaatatatctttcttcaaatttatctacacgaacaaattttcctaatatcgattgaggttcaaaatcaaaatttagatacatgcgacatccaccatcaggcaaaggggcaaattgtccgctccaatgaccacgataactattattttcaacatcatagtcaaattgaatattttcacgtaaatctgtaacaaaaatcttcgtttcccgctgttttcgatcatattcaataaatcgattatcaccaatctgctcaacccgtgttaaatcactacgccatgaacaatcctttaaattagttattactttaaaaactgctgctacttcacttttaaaatcaactgtcatatctattcttttcattttttgagccctccacgattccattataacacaataaaaaaagagaaagcgaactttctctaaataattattttgctaatgctttttttgctgtatttacaattgcagtaaatcctttaggatcacaaattgcgatttcagataacattttacggttaacttcaacgttagctaattttaatccgtgcattaattttgaatatgagatatcatttaatcttgcagcagcattgatacgtgcaatccataattttctcatatctctttttacttgtcttctatctctatatgaatatgctaatgaatgcataacttgttcatgagcagttttatataatgtatgttttgatccaaaatatcctttggctaattttaatactttttttcttctacgtcttgtagtaaatccaccttttactcttgccatttgtttcttcctcctatgtcaataattattttgctaatctagatttaattctcttgtagtctgatgcacttactaaagtagctttagctaagtgtttcttttgtttatgagttttattgtgagataaatgtgatacataagcatggctgcgttttaatttaccgctacctgttctttttaaacgttttttaagaccactatgtgatttcatttttggcatgatatattcctcctaaattattttttctttggtgcaattattgcagttagagttctaccttctagcttagctggtttttcaatttgaccaacttcagcacattcagctacgaagtcatcaataacttttttcccaagatccatatgagctaattgtcttcctctaaatctaattgcaattttaactttgttaccttcttctaaccatttcaatgttctttttaattttacatttttatcatgaacatcaatagttaccgataattgagtttcctttaaagcaaccactttagaattacgtttcatttctttagctttcttttgttgttcgaaacgatatttaccaaagtccataatacgacatactggtggtttaccgttaggggcaacacacactaaatcaagtcctgcaccataagcaatatcaattgcctggttacgacttttgacacctaattgatcaccattttgatcaatgactagtacttctttgaaacgaattttttcgtttactaactcatccggttgttttggttttctgttatcaaatctgctaataaaagccacctccattttagtagtttaaacaaaaagtgagcacactgagtacccacacattgacattaagatagtttatcttagcgacatttgcctatcgacataatcaatcaggcgagaagtaggcacttcttctttccactacttttcatttacttgagtatattatcattttatttaattaaagtcaacccatatttaaaagatttattcatcttcatctatttgtaaatatttaaagtatccaaacaccgaaaagactatcaatactattaatgcaaacatttcatcaccactaataatatatgtaatcccaataaaattattacttgtttttatgattatgtttaaatactttccattctacagcaattatatttattaataaatataaacttagccaaattcttaatattttcaatatcaagataccaccatttatttctcacttagcgaccgcttgccccctagttcttcttgtgtcaaattatactgcgcccacagcctcttgctactatagcatatcggctaaatagaagctagaaaatgccttgctacttatcataacaagacattatttaaacatttttttaaattcttctggtacaaccgctttaaattccattctagcttttgtatccggatgaacaaaggcgaatacatgactatgaagtcccattcgtttaatcggattagttgtagcaccatactttttatccccaacaatactatgacctaatgattgcatatggacccgaatctgatttttacgacccgtttcaagaaatacttcaatcaatgaattatatcgtgattcttttaatactttataatttgtaatcgccaatttacctttaccattattagcaatataaaccatttgtgtcttactttcatcaaggtgatttttaatcgttccatgcttctttttaagctttccttcaataattgccaaataaccacgcttataaacaatatcattccaattattttgtaatttatttttaattatttcatttttagcaaacaacagtacccccgatgtttctttatcaagtcgatgaacaataaaaacacgggcatttttatttttacttttaagatactctccaactaaatgataagctgttttttctttttcatttcctccggccatacttagtaaaccagccggtttattaataacgatcagttctctgtcttcataaataatatctagacttgaattattattaggattacgatcaacaacaatctcatcatcccgttttaatgaataatcaaactgactaatcacttgcccgttgacagacacctgcttaaatttaagtaaatttttaacattctttttattatagtgatttaataaaaactccattaacgtagaatctgtcttcactaaatacttattcatcgattttttccgccttaactgccgttccagaaacttgacactcaatcatattgttgccaaggtttgttgttgtaaagcgaacattaatgattgctgaagcatgtcttcgagaagcttgagcaactgtttctgccatcgcttcttgtcttgctgtatctaacatttcttcaatattagtattatcactagcaattgcctgattcatgattttactgctaaaaacgattcccagactctttgtaattcggtatccgggtaaataatcaatcgtacttacttcaatcatatccattatattttcctccttataagaaaaggttactaaagtaacctatttcatatcaatgattcgatgagtattaaataatacaactacaacttctattaaataaattactaatgccagccaccaaggaataataaataaaacagctaagatcattaagattacattaataaacaatcctacaaaaatattttcaatcgtaatatatttttgtttcttagaaatcatgaatgtttcaataacggtattaagatcagaattcatcagcataatatcactattttcaatcacttttttatctttgatgccaccacggctaatacctacataagctttttgcaataatgcaatatcttttgaattatcaccaatataagcaactggtccagcaatacttgctttatccattacttctaatttttcatcaactgtcaaattattatagattcgatactgatcattttcaagatcaactggtccatcattgaaaataatcaagccaacatgtaattttgataatttagcgaataattccatttcctcttcagttacttcaactccatcaaaacgatcataaataactgttcgacataaattcaaagcatctaaaccactattttctttaataacaatatttttagaaaaagctttagccactcctgatagaacagcaaaagaagaagcctgcttgtaagcaaaagaaccagaaattgttattaaaatagcccctaaataaatatatttaaaatttgcttcaaaattaagaattggcactaatgttgcacaaagaattcctgcgacgactaaaagaactgtatcaatcttactgattaattctaccagcctatgcgttcttgaagaaccaacaggtgccattgtcgcaatttctaagactctgctcattgcactgcgatcatacgtatataaaattttaattctcaaagtgtctttaacattgacacttccactttgaacttcacttccggctttaactggctctaaaatatctgatccattaatggcaaacatatctaattcactttcacccgaagcaatcttgccacctagaggtatcgtttctccaggtaaaactacgatcacatcaccaatatcaaaatcttctaaagaaaccatctcatattcattttcaccaatttctcgacgtcccaattgaattgggttgatctcgtcatcaattttctccatcgttaaattgattaaacgcatcaataaccgttctccaacttggtaaatcaaagaaaccacgatagcctcaatataagcaccataaacccatccaaataaacaagctagattaattgtaatattttcacttaagaattgtttaacttttaaatctttatatgcttgaaccaaggtcttttcattaaaaataatcaaagcaatcagccaggcaatattagttataaaattaggatcatcttttgtaactaatccaagtgctaaagctacaaataatcctgcaattctaatcattgtatttaaatatttttgttgaaaaatatcttgtgatttaaatggcttcttccattgctccacatcaattttaggattaactttatcaactagacgatttaatcgcactaaaatattcttttgactagttgtgactttaagtaacttattagtaaaatcaagactaacattttcataggctgaatatcgtgaaataacttcctcaatttcttttgcctcttcttctgtctctaaattagtaaacataaaaatatgttctactttttgttctggtgccacgaattcacgcttacgtgagttgatttcctcttttaaaacaagattttcatcatgattattcaaaaccgcctgcacattttcaggatcttcacaataaaatgaaatacctgtttttccaatcttgattcgtgaaacttcttccatttcgtttaagaggaggctgacctcatttaatttatcattatcatttatattatcaatatagaaattacgagccatagtaatctcctttccaatagtcacctaattttagcatatcttcaaaaaaattccaactctactcattaacaccataaactaactgtaaaatttgaggataataacgttcaaattgcaatgcatcaatttccgttggataagacattaaatgaaaatacagacgatgttttaagttacgcacaggtggtacaaaataatcatgctgatcatttagcactaagccatttctttgataaaacgcaatccgtcgacgactttgctcatcttctggatgttcaacttccaaaataaccggtttccctgccgtctccataaaatattttaacatcttacttcccaaacctttgcctttttgattaccatctattgcaaaataatcaacaaaagcaaattctccaccatcataatgtgataaaatacctttaatttcatcatcttcttttaaagtcaaaactttaaaatcaccattaataaaagtctctttcatataatcatattctttgatttctttactaggaaaatttcctaaaataactttataaaaatcattaaattctgctaattttaaatcttcaaatatcattttctaacccccgtttttttatttattaaaacaaagttttcttcaaattcctctttagtacatgacaaatcaaactctttaccatatattttataatttacctgaagctgaccactatcacgaatcacacaatcgtaaacttggcccttagtaaatagatcccgctgttctttaccaattacaatattcattgtcttgatacaacgacacacgcgacgttttcctgtatttgcgatagtaatcacctcttttctcattcattataacatgataattaaaagaaaagtaagaattagccctgctaattcttactgaattccaataactctaaatcaggattcttctctgtagcccaacgaacgccccaatcattagtaaataataataaatgttgtccttttaaatcttgtactttttttgtatcactagataaatttaaagcttttaaatcgcatccctctttaacccagcgcacatattgatatggtagcggctgcttgattatctcaacattatattcattctttaagcgatattctaatacttcgaattgaagtaccccaacgacaccaacaataatttcttccattccaccgcctaattcagtgaaaatttggattgctccctctttagcaatttgttctacacctttaacaaattgttttcttttcatcgtatctttattacgaatcaatgaaaaatgttctggagcaaaggtaggaataccttcaaaagcaaatttagctttacctgttgtaatcgtatctccaatcgaaaagatccctggatcaaaaactccgatgatatctccagcataagcttcatcaacttcttgacgttcatcagccatcaattgttttgactgattcaattttattttacgaccaccttgatagtgatatacttccatccctttagtaaatttaccagagcaaattctaaagaaagccattcggtcacgatgtgctttattcatattagcttgaatcttaaaaacaaaggcactgaaatcttcactaaatggatcgattgttttttcaccagtacttcgtggtaatggtggtgttgtcatttctaagaaatgttttaaaaatggttcgattccaaagttagtcaaagcagaaccaaagcatactggagaaagtttaccttgacgcactttttctaaatcaaaatcatttcctgccatatctaataactcaatatcttcctgcagcttattatataattcttcatctaattcattaattaattcaggatcatcatatttcattattttagtatcaacttctttacgcccgccatcaacagggataaaacggattacttcctgatcatgccgttcataaacacctttaaactgttttccagaaccaataggccagttaactggacaagtatcgatccccaattcttgttcgatctcttccattaaattatatggatcttgagcttcacggtccattttattgataaaagtaaaaattgggatattacgcatcgtacaaactttaaataatttacgagtttgatcttcgacccctttacttgcatcaataaccataactgcacaatcagctgccattaatgtacgataagtatcttcagagaaatcctgatgacctggtgtatctaaaatattaatacaaaaaccatcataattaaattgcaatacagatgatgttacagagattcctctttgcttttctatttccatccagtcacttgttgcatgtctgctgttcttttttccttttacggtacctgcctgttgaattgcccctccgtataataagaatttttctgttaatgttgtcttaccagcatcgggatgggagatgatggcaaacgttcttcttttttcaacttctttgataaaatcgctcatttttatatctccttgcaaggattaatcatatagatttataatgaatttgtcaaccgaaatctatttactcagactgtttaacggagtcttcgtaataatgaaagcaaagacagtgaagattacaaatccaccgattatcacaaacggataaactattaattttcccgattcaatcaataacggtaaaattgctaaggcaccagctggcggaaaatataatttagtaattttcataatgctcaacatggtcattacaattataattgcactaatagttaatggcaaatcaccaatctcacttatcaaaattcttccataagcaccactaaatgcacaaataaaggtaacaaatgctaatttaatcgaattatgacgcaactttgggtgattactactcaattcaacaaaagcaactatcaagggtggggcaatcaaaaacggtaattttaattgtaaagcaataaaagccgttaatgctaatgcacataaccgttttaaatttaagctataggtttctttaactgctgcagtaaccggatgatattcctgaacactacgatagccgcccttctctaaatattgttgcccgattacaatcaaaatactcattgcagtagcaaaaagcggatacaaccatgactcactattaataataattggtaagatcgttgcagatatcaatggagcaaacgtcgttttagataaaaataatcccgtcacacatactacaaagccaattaaaattttaaaataaatatcaatatctacatatttaaccaaaataatccctaacgacgcataagtcgcaattaaaaaaaccaatttaattttattagttttccatacttgtttaggcgctaaccatgctccaatcgtcaatgccgtaatttctggaaaaataaattctttttcatgaaacacttctgacatcaagatcattaaagctactagcaagatcgtcattatctggggaacaatacttttctttacttccatcattttcacctcaatagaactcattctattacaaaaagcgagtatagtaaataagaaaacgatataacctaaccgttatatcgtcatttcttaaaatacaaaatttccgttttcaaatatccttactacttgaccatcttttgtttctcccacaattttcaaatcactagtaccaatcataaaatcaacatgagttaatgaatcattgactcccttttccaacaattgttctttagtcattgttaaaccaccttgaatacattcactaaagccttttccaattgctaaatgacatgaagcattttcatcaaataaagtattatagaataatgttttcatattagaaattggcgaatcatatggtaccaaggcaatttcacccaaataaagactaccttcatcaatactcaacatctcttttaaaacctctttacccatttttgcatcaaaatcaataattcgaccatctttgaattccattttaaattcatcaatcaaattaccattataatttaatggcagagaactatacacaaccccattagtcccattacgatatggacttgtaaaaatctcctcggttggcatatttggaaaaaaatattgtcctttagtcgtataagaacccccaccagcaaataggtaaccctcatttaaggtaacagttaggtttgttccaagcgaattagtataagtcaatgtatttaaattcaatttatttaaatatgctactcgagcttcaaatcttttacgatgttcctgccaggcagtcaaagggtcatcatctacgactttaaccgctttaaaaatagcattccacaacgcctctactgcctcactatcagacatatcaggatatactttatttgcccatttaattgaactgccagcaacaatgcaccatgtatttatccccaaatcaaggctatcataaaatggtttacaagcagttgatacactttttgaccacaatgcgatctttgcaggatcgattcctttaaagccttcaggatcatcactaataattgttaaaaaggcagcctttttagcagcataatcatttctaaattctttaaaccacgttggaacatgagcaaacgcttctttttcaagatatttatatttatatcgtgaaacaacttcatcattatattttacaaccacttccctagctccagccgcatatgcctccttagttactaaacgtactaattcaacactctcaacaggtgcatcgattacaacaatttgagctggctgaacatttaaaccagctttaacgatcaattgtgcatattttgataatttttctttaaacgacatctttatctacctctttccatcaatttattataatcaatctaaacttctttatacctctttatcgagcttattcaactcttcaatcgcctctttcattcctttattggcagcctgcttaaaatactctttggctttttgtttatcttgattaattccatctccataactatacatatagccaatcataaaactagcatcataatacccacgttcactagcctttaaaaacaatttaaaagctgaagctttatcaactgttgttccaataccataaaaataacaacgtgctaaattatatattcccggtacatattcatcacttgttgaagcaagatagtatttgaaagcttcatctaaatttttatatccgccaattccattttcaagatatattccatacatattcatagctggtccatagccttgattagcagcaatctgcaaataagtaaaagctttatctagatttttagcaattactttaccttcatctaaatataaagccatccgatacatagctcggacatcattttgatcaattgcagcttcataatatttgattgcctttaaatcatcatgatactgttcattatgctcatagatcaaacctaaattataaagggcaattccataatcttgatgacttgctaattcataatactcaattgctttatcaatatcaacatccactccattaccttcttcatatgccaaagctagatgataaagacccggagcataattagcttctgcagctttttgatataacttaaaagcttgatgatgatcaacatccactccttctccatgatcgtataagtaacctaaattacataaagcccgcggataacctgcatctccagccaagcgataatagcggacagcttcatttaagtcgacatctataccaattcccatttcataacaatatgctaaattacattgggctggagcatacccttgattagctgctttattatatagctcaattgctttgattaaattttgtttaactccaaaaccactttcataacagtaacctagtgctacgattgcctgaacatcattttgtttacttgcctgacgataccaatatgaacagcgatatggtgcatttttaatttcaggatgattctcataaaaataacccaaccaaaactgtgctcgcgaatatccttgacgtgcagcttttaaataattttgacgtgcagcttttaaatcaatatcagttccttgacctaattcgtagcacgacgctaacgcaattaaagcaggagcgtaattaacttgactagcttgataataccaataaaatgctttaacaaaatcttgaattgttcctaatccattttcataacaataacccagacggtgttgagaacgttcgtgcccttggttcgcagcttcttcgtaacatttgaaagcacgttcaatatcttgttcaattccttcaccaaattcgaaacaagttcctaagctatacaaagcctcactataccctagtttagccgcctgataataataattaacagcacgtggaagatcaacagcagttccatgaccgtattcgtaacaatagcctaaattacaaatagcacgagcaaatccagctcgagccccaaattcatataactcaaaagctttctgataatcttgtttcacaccgattcctaactcatagaaatatgctaaattgcagcttgcgacaacatttcctaaacttgttgctgattgataataacgaaaagcctgataatgatcttgttcgacacctagtccacgttcatataaataaccaataatgcaaacacaatcactattatccacctctgctccctttttaaaatactctaaagcttccagatattcatgtttatcaaataatttcaaacctaattcatacaataatttaccactgacattatttatattttgtaaacgatcaacttcatcaaccatcaaaagacataggtcaataccaattatctttccttgattatcctcaataagatattgttcataatctaaatattcactttcattgattacttgcaatcctaatctatttttaatctcttctacacgtttttctaaaaattcaatattattatcttgatcatataatgttattacctttaaaagagccgttttctcaacaccaatcgcttgatgtttaatttttatcaatgattcttgatcatgaatttctaccagttcttcaaacaaccattgattaaataacggctcataacttttaacacgatcttttatatccatacttacctcctttcgatagagaaataagcagatattgttatctgcttactgtccattaatcatatgagatatctcttttgaatactttcctaaaattgcactaaccttgttacttgtttgaacgattccagaagcaccaagtgcttttaacttatctaaatcaaccaaactatcatcatttacaaagaaagtgacttttgaagaagtagctgttgtttctttaatattcgtcttaccgccgacagcttcgataatactatttacatcaactggaatatcagcagctgatacttgctttggttgcttatttttcattacttttaggaaaataaacgctaatattacgattacaatcagtgcgattattccatataataaatattcattcattaaaatataccccctattaattaccatttaattatagtatactataccatgatagaaaaaactatcatttttataaggagggattttgtggaagaaaaagaaaaatccgttatctgttggccattaatcggtctattactattgctttgtttcattagctgtctgggaattaaaagcgccactcctttgattactaaaggaaatccaagtggctattggattaaacagctaatgttttatggaatatcatttatcttgatgtttatcgtttataaagtctccaacgatcgaatctattcatcgatgtggatcatttatggaattttaatggttttactagttggtcttgctattgatcactttgcatttacgcgatttggaatacatattgttcctttagctaaatgggcgggtggtgccacatcctggtacaatctcaaagtatttgatctccagccatcagagtttatgaaaatcatcatggtggttgtcatggcagatacagtcgataaacataataatcgctatttagtacataatattcataatgattgtttattgattggtaagctcttagctatttccttaccaccttgtatcctcgtttatttacaaaatgatgccggagtaacaatgatcatgcttgcatcagtagtattcgttatttttatgtccggtattcaagccggctggtttatcataggggggattgtagttgcaatcatccttgggattggagtttatctattcttataccaacatgatatttttgctagtttaatgggaggagaccataaattaaatcgtttctatggctgggtcgatcccgagggtacctataatgatcaaggcttccaactgtttaatgcaatgttatcatatggaactgccggtctatggggacatggtatgggaacagctatcattaatcttcctgaggcacaaacagactttattttcgctgttattgccttaggatttggatttgtcggtggcggtttcactattgcagttgtctgtgtacttgatgccttattaattagaattggttttaaatctaaaaataatcgggataaatatctcacagccggaatctttggtctacttatcttccagcaagtttggaatatcggaatggttttaggactctttccaattactggaatcaccttaccatttctatcctacggtggttcatcacttctttcatatatgattgcaatgggaattttcttagatatggaacgacaaacgcgaatcctcgaaggaaaaaagcgctattaacttattaattatataagatgatttattaaatgataaatcatctttttatttcgataaaaaagattccttcatttaatttcagctatttgctatccatttatgaggaatcattttaattcttttcaaattgttttgaatctttctttacttcaatcagacgttgtgtaaaagggtcaataaaacttaatgctatactatccaaatagtaagattcttgataaatcgaatcataaagtgtatccccaactaacggatgattgatactagataggtgaaccctaatttgatgagttcttcctgtttctaagatacactctattttactctgattagcacttacctccagtccccgataatgggttacagcaaatttcccagctggatgaatcagtcttttaacactttttttatctttaataattggcgctgtaatcgttccttgtcccgtcaatactccctctactacacagtgatagacacggcgtacctgcttgatatctctagacaataaataatgagcataactgtttttagctatcaacaataatccttgggtatctttatccaatcgattaaccaaatgaacagttgcctttattccctggctttgatagtaataaacaactgcattggctaaagtatttcgaggataacgctttgtaggaatacttggtaatcctgccggcttatcaattactaaaaaattttcatcttcatagctaatttttaaagctagcggatatggttccatagtactaacttcttcaggccacaataattcaacaacatcaccgtaccgcaaacaatatcgtaccgtttgacgctgaccattaacaagaatcttcccatgcattttaattaatttaacagcttttttactaagctcctgttgactaagaaattctcttaacaacattccgctttctttcattgcgacaataaatttcattcgctgataaaagcccttctaattcgttgaataaaagacatttccttatattctataaactttactactttcttagaaattctaatttcaattttttcaacatcatcaagatgataagataagtgatcaattcccaaataaactcgattaaaatgctgtccttttaacttaatcaccttattttcatctaaaattaaactagcacccaaacttcgataagcattatgttgtatagcggcgacttctgtcagttgcattaagggacttcctggataaataacagctccaccaattgacttattataagccgtcgatcctgatggtgtagaaacacaaagaccatttcctctaaatacttccaaaagctcatcatcaatatagacatcaattacttgagttgtatacccatgatcaatgcgcatctcatttaatgctaaatatgtttctttacctgctttatgatacacatcaacttctaataaatgtcggggcgtcatttgataatgatcagcttttatagccgcaatcaattcagtaatttcatctttttgataatctgtaaaaaaaccgagggttcccgtatgaacacctacaaaactaactttttgctccatatattgatgcactgacaaaagcattgttccatcaccaccaacactaataaccaaatcaggatcatcgggattatattccataattccggttaaccctttcttaattttttcagcaatattagcagacatttcatcctgttttactactaatgcatattgtttcattgttttcaccaaccttagcgtatatactatagtatatactaatggaggctactatggaagaaaacttagaaatagaatttaaagtattgatagacaaagaaatataccagcaaatctataacgatcaccacatcgaccatcaatatagtcaaactaattactatttgattcaccctaaattaactgaattaaaatatatgctgcgaatccgtcaaaaacaagagaattatgaattaaccttaaagcaaccacaatcatatggaaatttagaaactaatctaaagattgacaaaataactaaagagaaaatcattactcacgattttgttactaatgaaatttttgaccttctaaaaccccttggattagatagtacgatgtttaaaacagactgtgtacttactactacacgttgtgaaattaagactactgatggcttgatttgtctagatcaaagtctttataacggaattactgattatgaattagaatacgaagtatttgattatcatcatggtaaacaaatatttttagactttattggtcaatataatttaaagtattctcgtaattgtcctagcaaggtaaaacgtttaatggatagtttaaaagatgattaaataatcatcttttttactagaactaaaaaagcagcgtttcataacactgctatctatctttaaaataagcctctttaattgagcatggttcactaataaattgtggacaaacttcactacttggacattctgctaatttacgtaactcacgaggaataaatacccggatttcctctgcattataacctacctggaatcttcgctcatcaatcataattgggcgttttaaaactgatggattttcttgaataaacttgatcagctcactaattgacatgctatcaatgtcaatatcattttccttaatgattttacttcgcttagaaatgatatcgtctgttccattttcgcttcgttccaatagttcttttaattcaatttctctaagcaaggttgaaaaaatatttttttccacataaggaatattatgttctttcagccaagacttaacctttcgacatgatgcacaactcggtgctgtgtaaatacgaatcataataccatctcccttacttcactattatacattatttttattatttttctatcattttcgttaatcatagtaaaataatatgcaaatcgaggaacttggattaatcaagttcctcgatcattttaattacctctatttttgaaaaacctagtttcctcatttcttcaataaaaactttaactttatcaagtgaaacatctttttttaattcactgatcaaattactgtcttcactgacaaaacgtcctaaagctcgcctgctataaattattcccgttctttctaattcacttaaagctttttgaattgtattgggattaactccatattccaacgctagctctcttactgaagcaagcttacttcccggtaaatactcactagcaaaaatctctttttttatttcttccatgacctgaatataaattggtaaattaggatcgaagtcatttttcattctaccacctactctacttcaattttatgatcaattaaataaacagtgaagaaataaaatgctgttgctaatactaaatttaaaacaatgctaaaccaaacagaagcagtactatccaaactcattacaaagctctcaattggctgccacattaataagctgcttcctaaaattaaaagtgctacataaacaataattccaataacagttttgtgtttaggaatatatttagtctttgttaatgtaataatagcataaaatgataatatcattgaactaaccatcgcaattgaatcaattaaatttattactactaaaccaaaattattacctaaagcctttaacaactcaccaaataaatcaaataaagtattcaaaggaacattaccaattaaaaatacaataattaatattcccagtgataaaacaatcgaactaacaaacacccaaattaaactacctataaatttagccccaaccaatttttcagtacttacaggcaacgtcaaggttaaataaccaggtcgcttatacattgaacgattaaaatttgtaataacattgaccaaaactgcaattgatatacctaacattgcaaaaatcatcaatgaactcaatacttgactaataaaatctggcaacaacggtgccaaaacacataaaatcaaaaatattcctaaagttaaaaagtattgacgatacgattgaatcatctcatattttaataattttaacatctaaatacctccctaaaggcttcatcaattgactgttttctttctaatcttaaatcttctgttgattgatgcaaaacgatttcaccatcttttaaaaacacgacatcatcaaaaatagtttccaaatcactgattaaatgtgttgaaataagtaccagagcatcttcttcataattattcaaaataacatctagaataacttcacgagcagctggatcaacaccagctatcggttcatcaagaatatataatttagctttgcgtgacatcaccaatgatagttggaatttttctttcattcctttagacatctctttaattttcattcccttatctaatttaaaacgattcatcagagtcaaacaattttctttatcaaaatcttcatataaatcactgaaaatacttaagacatctttaatatacatccaatcttgaaaataattctcatccggtaaatatgaaataatttttcgtgaatcaattcctacatttttcccatcgactaatacttcaccttcataatctttcaataacccattaataattttaatcaatgttgtttttcctgatccattaggacctaataaaccaattattttaccagattctaatgtcatcgaaacattgtttaaagccttaaaatgatgatattttttggttacattagtaatctttaatagttcactcataactctcctcctactgtattaatacactaatacagtaacacgcatttatagtattgtcaatacaattattcttatgactcaaaacaaaataaaaagatttttctagttatttacatagaaaaatctttttatttattttttcacaaattcattataaagaagttcatgaataaaagaatatcccttttctaattttttctttagatgaagatatttaccaatacttttatcatcattgatttccaactgtttacaaacatttagaaatttatcatagtcttcaacatataattgatcaaccatgttttcaacatattgttttttaattcgttcattgcgtgttaagccatattctttgattaaaccctcatcatacatgtgataattgatctttactatcggtaatttttttaattcatgattaattaatgttcgctgtttcatcatcgttaatgaacgataaactaatttaccattattatttatttctacgactacactatatttcccatcaccaacaataaagatgttattaaaatattgactatcataaatattgatacagccataaataaaatcatgcaaagtcttctcatcaacatgataaatatctactcttgaaatgatttctagatcatcatcttcatcccattcatatggttctaataattcttcatcttctttaacccagtttacaattatatctttcatatcttcctcccatataaatatatgattattttataaaatcatgtttttagtatatttttatttttaattaatatataatgattcctgaggtgaaaacatggaattaattaaaaatatcatcatttatggtattcttggagcgattcaaggttttagtgaaccaattcccatatcaagtagcggccatttagttatttttcaaagtatttttgaaaaaatgggactaatggttcctcaaatgaacgatgttacttttgaagtaatcgtcaatactggatcactactcgcgatcatgtattattatcgccacgatattgttagattattcacagctttctttggctatattcgaaaaccaaaaaaaagaaactattacgaaggtgattttagatactgtattttattgattgttgcaactattccggcagcaattggaggatatttatttaatgataaaattgaagcagctttttctaaccctaaattagttggatgcatgttactggttacagcgattttcttattatcaatccataaatttggctacaaaggaaagcggacagcaaaaaaattaaacttattcgacgctttaagaatggggatttttcagttatttgcattacttccaggaatctctcgtagtggttctaccctaacaggaggaatgttagggggattatcacaaaaggccgctcgtgatttttcattttttatgttcatgcctgttagttttggagcaattattttaaaactaaaagactttttaacatccagcacacttggtgctttatggcttccttatttagttgcttttattataagtggaatcgttacatatttggctctacacttattatttaaattactagataaaaagaaattaaatgtcttttctttatattgtttagtagttggtattttagccgtattatttttgtaaaacagtttaaaatgaaatgtctctccattaaagttcatttcaaaaaactgttttttttactattaattttaattatatctgtaatattcatttctttaccatcaattttgattatttttttgtatagatcaaaggctgtaagtatatccttgagaattgcataattatcttgagcataataagcagtttcgatcatttattcacttctaagctacctaatcttccagtccaactcttctattgcatcaagagcaagctttttcgttcgataatgacccacaatttagccctgaacaattctttaaatccttttagtggatcataagataaaattattttacacgttcggccttttcatcacattgaactattctctttccaacatgctaaaaaccagttaatagctgatgatgaagttacaataaaaaaataccattgatttactttaatcacaagtaattcgatggttattgataaatactttgatcctcaccaaatcctagaattaccaataaagataattggcaaagttatttttactaaaaactattattaagtaagaattccatctctcactttttaatttgaacaattgcacaagctccattttcgttatttaataattttagaataccgccatgtttttcacaaaggatcttactaatcgataatccaattccaaaacttcctttattagtctgtgatgaataaaataatgtagttgcattttctaaatcctttttactaaaacccggcccatcatcctgaataacaaattcaagataacccacagtttccataatcgttaacttaaccccattattagcaaagcggaaagcgttatttaacaaattttctaatattttaaaaataatctgtttatcaagatataattgtttagacactatttttgcttccaatactaaatctttatgattattcttagcaataatcataaaatcattattaatttcttctagaaaatctttgccgacaaccattgtcttactaatttcaatatcttctattttttggatatcttgaatacattcaacatatcgctctaaacgagctgatgaatgagccatactttttaaggtcgttaataaaacatcatcagatactctcttttctggaagattttttaataaataatcaaggtatcccttcaatactgtaatcggggttcttaaatcatgtgatactgatgccgttaaagcttttcgctgatctaaaagttcccatactttttggttattttcaatcagttcattacgcattacctctaaagtactacataaccgacctaattcatcattagaattataagttatttgaaaatcaagattattattggttaaattagcgattcctatatttaattgttcaatcggcaacgccagttttaaacgatagtatatctttacaataaagattgtccctaaaacaagatataatgttggtaatgcgatcatcgctactgtcgcactaagataaataaatttatcttgattagccaattcactatactgatactcatcgtttgagggcgagatttcatacgtacctgtaatattttcactaataatagcggtatctactgcaatatgaatagtccgattatcaagaatcatttgtcgtaatgatgaagtcaacaaaactgttgtagaagacaaaataataattaaaaataaagctacacttaatattaataataatgatttttttaaagacatgttataaaattgctgttttattttttccatcgataccctacgccccacactgtttctaagtattcattttcactataccgggataatttcattcggattttacgaatatgttctttaattacagcactatcaccattagcttcaaagccccatactacttcataaattttttcacgatcaaatatttgaccagcattcatagataataatttaataatttcaaactccttattagaaaaatcaatttttttatttttaataattacggttctttgactataatcaataatcagttccctagtaaaatgtcctcgtgatttatgggagctgcgtttttcacgacgtaaatgagcttgaactcttgcgaaaagttcatccatcgaaaatggttttgtaatataatcatcgcctcccagcattaaaccattgatcatatcccgactagaaattcgcgctgttaaaaatataatcgggcaattcacatgttcccgaatcatcgtacataattctaaaccattcatctccggcatattgatatctaataaaataaggtcaggtaaaactgataattgttttaaagcttcattagcatcattagctaaataaactaaatatccttcagattgaaattgtaatgccagcatttctaaaatgtctctttcatcatcaatcataagaatcttatacattgttttttccccctatagttatttttattatacttaagtttgtcaatttttggtcaacttcataaaaaaacttaagtattatgcatcaacctgcaatcgttagatttttaaggttcaatacaataacttaagctcttttataattatttagttgcaataacttctacttcaattaaagcccctttaggtaatttagctacttctacagcactacgagctgggaatggttcaacaaaatattgagcataaatgtcatttacagtaacaaaatcatccatattatctaaaaatacagttgttttaataacatttgcaaatgttaaaccttggctttctaataatccttgaacattctttaatgattgatgagcttgtgcttcaatcccttcaggcatttcccctgtttctggtactaatggaatttgtcctgaaaagaaatacatatcaccaacattaattccttggctatatggcccgatagctccaggtgctttatctgtttttactacatttttcatctttaatatcctccttaaatcattataaacaaataatcactatttttaaagttttattaattaaaatattgccatttttatcactgtgataatttattattgacttattacaattctttgctataatgttgacaatacaaaaggaggatagcacgactatgaaatatacatttgcagctagatttaataacattactccaagtggtattcgcgctgtactagaaaaagcagcgggacccgatatgatcaacttctcaccgggctttcctgataacgatgcttttccagctaatgatattcaaaagatttcacaagatgttcttaaggaagatatttatactatcttgcaatattccagaggtaccacttatccaccattaaaaaaggcattaaaagctttctttaatcgtcaagaaaaaatttttacagaaaatgatgatctaatggttacttccggctcaggagaaggactggaaatggctgccaaagtatttttaaactcaggagaaagtatcatcgtcgaagatcctacatttgtcggagcgctgaatggatttattagcaatgatgctaaactgcttggtgtgcctgttgaaagtgatggaatgaatttaggattattagaagaagcaatgcaaagcactcctgcccccaaactactatatattattcctactttccaaaatcctacctgtatcactacttcactagaaaaaagaagagctatatatgacttatgtttaaagtataatatcatcattcttgaagataatccatatggcacattgcgttttaaaggtaaaaccatcccgactttaaaatcaatcgatactgaaggaatcgttgtttactgtgcaagcctatcaaaaatcatttctccgggtatccggcttggaacaataattgcgaataaagaaattattgataaatttaatattcttaaaggggctagtgctggagccgtaactaattggtcacaacatgtaattgcacgctttttagaaacagttgatatggataagcatcttgctcatttacaatctgtatatggcaagaaaagtacatttatggttgaaatgatgaaaaaaacttttcatcctgatgtaaaattcactaccccagaaggtggtatgttcgtatggtttgaacttccaaaatatgctgatgctaggacttttttgaatagagctaccactatgcatatcgcaattgtaaatgaggaaacttttgccgttaacagacgtgataaaatgaatggttttaggttatcttttactagtgcaacaatggagcaaatagaaacaggtattgctaagttaggtaaactaacatatgaattatgtaaataaatccactgattggtggatttttatttgttcgcgcgtataattgaaatgaggtgactaaaaatgaaacgtggattagttttagcaggcggaggttctaagggagcttatcaagccggctgtattaaagcattaaaagaattgggctatgattttgatctagtaaccggaacttcgattggagctctcaatggcctattagtcgttcaagaagattataacactctttatcgattatgggatgaaatcacaattagtgaagttttagaggatcctgtcaattttaatttttcaattgactcaatgctttcacaaaccaatttaatcaaacctttttttaaatcatatatcaatgaaaaaggtgctgatatcactcctttaaaaaacattctccatgctctttataatgaagaaaaagcctttaataataaaatagattatggtgttgtagctgtaaaatatcctaaattgactcctatcgaaataactaaagaagaaatgaagcctgtaccagccattgaatatgcaattgcttcagcttcatgttttcccgcttttccagtgcatcatattgataaacaaggttatatcgatggtggttattatgataatcttcctatttcgctagcgttaaaaatgggtgctgataaaattattgcaattgaattaaatcaagatgctactcatgattatttcctcgatcgtcctgatatcatatttattcgtcctagctatgatcttggcggatttcttgattttggtcgcgaaattcttgattggcggattaaacttggctatcacgatactttaaaaaaatttaaccagctaaaaggctatcgttataactttaaaaattttgaaatcaatcacgaattagcccataaattctatcgtttaattttaaactatgaagatagcataaataaaaatgtcgttagtaaaacaattaccagcagttcaactcccttgagtgatctgctaaagaataatacttatttaaaggaactaacaaccgaagattactttgttcgagcggttgaaatcactatggatcattatcactatcaaagtgatcttctttatgatctaaatgaagtgtgtcacgaaatatttaacacttttaaagaagaatatcaggaacgctatgatattttagaaaaacggtttgtcgacatacctattaaagaactcttctccaaaataaaaaaattaagcagtaaagatgctatttgtgctttttatcactcattaaataataacgaagaaatcgaaacaactttaattagtaatatttttttagaagaatatttaatcgctttactactatatacgcttgtataattaactaaaatttgctagaatcctcctaggaggaattagtttgaatctcaaagtaaaaaatatgatatattgttcaatgtttgcatgtatcactgcaatcttggcacaaattcgatttaccttaccaagtctagtcccaatcactttacaaacactcgggatttatttaattggtctggtgttaaaacctaaaatagctttcattagttccttaatatatattttaatgggagctatcggcctgcctgtctatagcggctttagtgccggtttaagtactatattaggaccaactggtggttatatatttagttttccaattacagctttaataatcagttaccttgtccattatcgaagtaccactatttttaagtttggcgctttaatactcggaacaataatttgttatttaattggaactttatggtttatgtatataatgaagatgagttttagtgcttcattaattatttgcgtcctgccttttttacctggtgatgtacttaaaatctttatcgcagcagccttaacaaataaatttaagaatataataaaagattagggaatttgctttcctaatctttttttcattttatgcttttgtttcttttcctaaacgtttatacgtttgataaaataatgtggctgtaacactaactgcaatcgtatcagcgattggctctgctaaaaatactgcaaatgcttgattttctataaacattggtaaaataaaaatcaatggtattaaaactaaaacctttcttagaacggctaaaaatactgatgttttagcatttccaatagcaatgaaagtttgttgacaagcaatctgaattccaaaaattcctgaagcggccatataaatacgaatcgcccaacgtgtatacgtcgccagttctccatgacttgtgaaaatataaataaaagtatctggtataaacatcgctactgcccataagagcattgaataggataatgagatttttaataaaagtttaaaagcgcgctttactcgatcaatattttcagcaccataattaaaactaataattggctgagctccttgagtaagcccttgtaacggtaacattgaaaactgcatcacgctagtcaaaatagtcattgaacctaccgcgatatctccaccatattttaataatgaagtattaaaacatactgagatgacactttctgtaaactgcataataaacggtgatagccctaatgctaaacatggtaagatgacttgaaaatctaattttaaattatctaattttattcttaagccgctacgcttacttgttaaaaaataaacaacaaagatagaagatatcgcttgagaaataatagttgctaaagcagcaccctttacccccattgacatactaaaaataaaaattggatcaagcacaatattgcataaagctccaattgcaactgtaatcatcccaatcttagcatacccttgagcattaataaacgcatttaaccccaaagccaattgaacaaaaattgtacctaaggcataaattctcatataatcaagcgcataaccaatagttgcttcactagctccaaagaccattaaaatcggttcaccccagattaaaaaaacagctgtcaagataattgccataattactaacatcacagtacagttaccaagaatcttttcagcttttgggtgttcaccacggcctaacatgattgatgctcggggagcacctcccatactaactaaagcggcaaatgctgaaatagccataataacaggcattgttactccaacccccgttaatgcactaggccctactttggggatatgtccaatatacatgcggtcaaccatattatataacacatttattatttgtgctaaaatagcgggtaaagctaattttaataataatggacctaagctatctttacctaaatcagcctcttttttctttttcactttaattactcccttcatctattttaaatatccaatgagtaattataacaaatttcaaagataattcaattctttaaaagattatctaatttacatcattttaaatactcattcatatatcaacatattgatatatattttttcaattattaaaaaacttagcagaattatcatttcttttttattcatattctctttgataataataatatttgtataacttgttgaattaagctattttggcttaatcaacaaaaaatcatacttataatttataagaaatcattgatttatgaaattttgctaaacattataaatcttattcataattttgtttcaataaaaagatgataaaaaataagaaccatggggtaatggttcttatttctttacatctctaaatgagattacttctatttcattatcacgaagccactgttttaacttttcacttgttacgagtgaataatcatataatctttcttttaacatcgaagaagtagtcgccacatcataatcaataaaaccaggatgtgttactaaaatattcaaaccttctttaatttgataataaccatcaatgaacatattttcaaagtcatgatcatgttcttcataataatcatattgtttcattgtctgatcaataatcccctgctccaagtccattccgtaataacatactggaacattatattcatgataaattcttaccactgcattaatcaatggttctacttctaaaacgtgtaaatcaatgtactcaggcaattggccaactaattcaatatatttttcaatttgatacttagcttcgatgtaagcatcttcctcactaaataatggttcattattttttatttgtgctcgacgaatcgtactcgataaaaatatcccgtgttcatcaactagactaggaatcatctcttttggtgctaatgcatatccattagttacattaacatgtaatcctaaacacagatttggacactgctttgctaatttaattgcttcttttgcatacggcatattaaccatcaaagcaacactatttaccaatccctttcgatgtgctgaaatcattcccaatgttactgcttcgctatatcctaaatcatcaccacgtatcaataactgctttaccataattatcctcttttctatattttatataattatactataccaaataaatagtctatacaatttattttttcatattcatgaaacatttatgatagtgcttatatttgcggtataataaaagataactaagggaggacaacacactatatgaaagatcgttttagtttatcatttaaagctttttatttaatctatttgggcgcgattggctcttttattccctacattaatacttatttagaaaaaaatgccggcttaagcggttcacaaattggcttaattacagccatcagtcttgttttaggggtatgcgtgattcctatttggggggtcgttggtgataagaccagaaaatatagtgcactattaaagttatcaattatggctgcactagtagtactttacttctattataaagccgctgtttatcctgctatcgtagtttgtgcaatcgcacttgaagtatcacgactaggaacaatgccgatggccgacacgctggcaactaattattgccataaaactggtggtaactatggttctattagaggaatgggctcattagggtatatgctggcaggaatggctgtaggatttttagctgatctttttggtcttgatggagcaatgtttgcaacatatgccgttttattaatcttggctttctcgatttccttcggctttcctaaagatgatggaaagaaagaagatggtgaagaagttaaagtaaaaaaagggagttttaaagaacttctaactaataaaaacttcttatttattctatttttacaactattaatgtcaacagttgtcgattctgctatgacatatggcggaaatcacttaactgttactttaaatagtggtgcctcagcaataagctggatgacttttgcaacagttttacccgaagttgcattcttgatgattgcaatcaaagttcttaataaaaccggctttaaaaaattctatttgattgcctgtgtatcaatgatgcttcgctttggggtatatgcttttattcccaatcaatatgcttttttagcaataagcatcgtacattgcatcggcgttgccatcgcaactgtagcaagtttaacctatattcgaaattccgttgatcccgcagttttaggaaccgctattacattacttaatgcgacactatcaattggtaaagccatttatggttacatttttggagtagtttatgaaatttggggaagttttataatgttcggaatttgtttgattccttttgtcattgctttcttaatgatttctcgttctcattgttttgatgaaatcgataaacataaaggtcatattgcataagtttatggatagatagttatatgctatctatccatttttagattaaattaaaatattttcttttaaataatataatttatattataatgatattcatggagaagtttatgaagaatatcacaaaaatgtttttatttatattatcgttctacttagtcttaggttccctttggattggaaaggatgttatcattcattatcaaaatattgatggtttaccaatcctaggttatcatggtgtcctcgaagataaagataaagaaaaatactttgctaattatccatactgtatgtcattgagtgaatttgaagctcagatgaagtatttaaatcaaaataattatcataccttaacaatggatgaaatcaacgattattatcaaaatcatacaccactacccaaaaaaagtgttgctcttacctttgatgatggcttattaaactttaaaacagttgttaaacctattttagaaaaatataattttaaagctacttgttttgttattggctataaaactacagtaaaaaatagccaaaacccttataagcatcaatacttaagaaaaagtgatttagtaaatgacgaatatgttgaatactattcacattcttataatcttcatcataacactaaatatcctaataccaaactaattgaaacattatccacacaagaaataatcaatgattttaaacaaaatgaaaatattgtttctagtaaatactttgcctttccatatggtcgaacatgtgacaatgctaatgaagcattgataaaagctaatgtttcattagcttttggttataaccaaaatagaacgatgacctatcatgatgataagtacttgttaccacgatatctaatgtttagtaaaatgccaatgttctattttaaatggatcgttgaataaaaaatgacaaggactgtttgttcttgtcatttttataattattataagacttttccattactagcaataaccttttgataccaataaaaactatcttttaaatatctctttccacttccatttccataatcatcgtagtcaacataaatgtaaccatatcgcttattcatctctgaagtacctgcacttatcatatcaattggtgaccagctcaaatatcctaagcatatgactccatccaactcaattgccttctttaactcattaatatgtttttgaagatacttaattcgatattcatcatgaatctgattgtctacagtcaaaatatcattagcaccaaaaccattttcactaatcaaaataggtaaattataacggtagtatatctcattcattgtaattcttaaaccaattggatcaatagcccaaccccaatctgatttttccaaatatggattttcaacaccaccttttaaattaccttcccctacttttctagcagggtcatgagatgctactaatgataaataataactaaaagatatgtaatcaactgtattatttttgattatgtctaattcttcttttgagaaatttaaatgaatatctcttttttctaaattttttaaataccagttaggataattcccattagcctgaacatctgcgtataaataatattcttgatttgctctcattgctttaagaatatcatccggatcacagcttgctggataagttgtaaatgaagcgatcatacaacccattttagcagttttatcaattctttttagctctctagttactaatgcacttgctaaaaactggttatacagtccctgatgcactcgtgtttcatataattgatcttgactaaagggaactgctgaacctttaaatggtatttctaatgccgcattgatctcgttaaatgacatccaatattttattcgtcctttaaaatgtgtaaaaactgtataacaatatgtttgaaaaaatttaatgacttctttattacaccagccaccatattcagtcgcaataactagtggtgtttcaaagtgagataaagttataatcggttcaattttatatttaagtaattcattaataatattgtcataaaatttcagtcctgctttattgggttctttctcgtcccctcgtgggaaaatcctcgaccagctaaatgacattctaaaagctttaattcccattttagccaataaagcaatatcctcttgataatgatgataaaaatcattccctcttcttttgggaaaattattacttttattttctttaagttttttaatttcttcaatggttaattcctttttagctaaatgacgttccttcttttcataaaacataaaaacatcggctattgacattccacgcccatcaaggtcatatccaccttccatttgattggcagcacttgcaccaccccacagaaaatctttatctaattcacacataccgaacatcctttcctttctctattattgatttatgatctcttactccaatcgcaaaatatcatcattatttactactgtattcatatttaacagctcgactttattataatgattagtatttgttacaataacaataatagttggatcatatcccgcatggttgatttcatcaatgttaaaatctagtaataattgtcctttcttgaccatatcaccttcttttacaaaagcataaaaaccttttccctccattttaactgtatcaattcctacatgtaataatatttctgctcctaatattgaccttaacccaattgcatgattagtcggaaatacagcaacgatcttagcatcacagggagcatataatttcccttcatcaggaataatagcaaccccatttcctaatgctaacgaactaaaagtactgtcatttactatttctaacggcaatactttaccagtccctacagcacctaatatctcagtatcaacctcaagcagttgatcagtttccttgattacatcatcatttttttcaataaattcatctttccaaaataataatactaatactaaagttccaataaatgaaattaataaaccggcaatataccatacaaacccatgttcagcaaacaatggtaatgataaaattccacctgctggcaaccccgtcgtatagcatccagccccaccaacaactgcacccccgaaaccactcattagacatgccatgaaaaaagcttttttagccttcaaagtagttccataaatcagtggttctgtaattcctaaaactgagggaattacatttgctgctgcaaccgatttaaaatttttattttttgatttaaaagcaatccctaatgcagcaccagtttgtgcaaatgctgatggcatcgtcattgctaacaatgcatctctaccagttgttgcaagattatttaaattgacaggaataaatccacgatgtaaaccaaaaataactaatggctgccaacatgcacaaaatataaatccaaaaataatcggattgaaactataaactgctaataatccatctgtaaaaatatttgttaaaaatgtcactactggtccaattgctaataatgataatggggccataataactaaatcaatcaatggagtaacaaaacttctaattattgaaggcagtctatcacgaatcagcctatccaataatgatacagcatatactgcaacaataatcggtactacagaagatgcatatttaattaaaattacatcaagtcctaagaaagataactttgcaccttcactaaaagctgtcaataaggttggatataacattgttccagctaaagtgactcctataaattcatctattttaaagtagcgtgatgcactaatcgctaaatagaacggcataaaatacaagattgcatctgcggcagcatataaaatcatatatgttccactttcagttgttaatattcccatactagtaaatatggttaacaatcccctcaatacacctgctcctgccataacaggaacaaatggtgtaaatatgcctgaaaataatgcaaatattttatccaataatttcttatttttatttgattgttcctttacagtacttattttagctgttgtcaagattgctttatatacatcagcaacatgggtaccaataaccacttgacactgtccacccgaaaataacacttgaagaatttctgaactattttctaagtttactttatttactttctcctcatcttttaattcaaatcttaacctagtagcacaatgctgtactatatttatatttttttcgccaccaacattttttataataaatcttgctaatttttcatatttcattttttctcctcctaataaaataacctagaataaaacatgtattcaatcatgtttttattctaggtttagcttgccaaagcaataacaatcctaatattttaatcttgcaatatgcaaagttaaatacaatttttccgcctgacttaaatcttttttataaattttttgaacatgtttttctatattttttacacattcaaatgcttctggatatctttcaataacgatgtcaaataatatatcatctcttttagcttctttttcaccaaacatcagccgctttgcaaaaaactttaaatgtgtcacaaaacgatgatagtctagagaatcctcatcaaatgatatcttcaaatgatatctcacaatattaagtgtttcttgaataattttggtaatttgagttacttcttccatttcactattaagttcagcattgacaaaatgtagagcaataaaaccaacttcatcttctgataaattaaccattaatttttggttaattattttcaaagcttctgctgcgatcttatattcctcttgataaaattgcctaatctcccataaaagcggattttgaacattaattccttgtaaatatctctctatagcatagtttatatgatcagtaagagttatatatattccatcatttaactctttatccaatcctttccgtgcaaaatcaataatttcatcagtaacattaagaacattgactggaatatccttaatcaattcaaggaagcgattgttttgtttatcattttttaaataaaattgtttttcaatcatttcatctggaacaacttctccccgtgatttttgatatgcaatacctcttcccataagaataatttcattatgattttcgtcaagtgagcttacaatattattattaataattttatgaattatcataagacacctccttttttgcatagaaaaagccaaactcaaataatatatataagaaatatatatccatcaaagtttagcctaattgaatagtaacaatctttgtaattttatgatagcacttccaaaattaattgtcaattaccaatcatatatatcaaaaattagttgttaatcccttgatgcggcacaaacgaactatctgtaattgcctcaaagcgataaccacgtgctttataattttcaattattgccggtagagcctgaacagttgttgatttggcagctgtatcatgaaataaaatattaatgttatttgctttgcttgatgtagcattagcaattaacttgctgactgctacattatttcctgaagcatctgtagaatcgccattccaatcataatattgataaccgcgattgattaattcccttgacaatacagtcataatacctggacaatatttacgtgataccgtatttgaagaacctccaggaaagcgtacatatttgggtacaaacccaattatatccttcaccatattaccgacttttgttaaatcgtcaaaataagcttctggtgaagcataaacagttttatagtcatgactatatgtatgcaacgctattgtatgtcctttatcatgagcagttttaattaaatgattataaggtttattattcccagtaacaaagaatgtcgcctttgctccataaacatctaaaatatctaaaatcttttgggtattagctgatggaccatcatcaaaagttaaataaacgattttatcacttgtttgattattgcttccaattgctttcttttcaattactttaatttcacgctgcttttctattttgtttccagaacgatctatccctatataaataagtgtataagttccctctttttgaatattcacattactagaatcaaccgttaattttggttcgggatcacggttatcactaatgctgacaccactattataatctgtttttgcccctatcacgatcgtcaaaggctctaaccctgtaatttggggtggctcactatctttagtaaccttgacttttcccttcttttcagttacattatttcctttatccttaacctgaataattacttcaacagttccctctttactaaaatcataatcttctttaaaagaaacttcagtttttgttgcatcattaatatttgttgccatacttgcaggatcaactttcattcctaaatcaatatcaagatcaacaacatcaaactgtggttttttagtatcaactatctcgatcgttgcttcatattttttatctttatatatatagattactggatatcttcccaacttattataatctattttagaaatatcagcttttacatctttaacatttccattgcgtacgcttgcgatatttttcatcacatcataactatcattaatctcgactttgataatatccgctttaaagactatcggtgagcgggttaaaaaatatgttgctactccaccaactattatgactagtaatactgatacaattacaatcttatttcctatagttaaatttttaatttttttcattatatctttcccttaactaatttatatacttttagtatatgtcaaacctcagtattttacaatctttgtcaataaaactatttataaaaatcaactaaataaaaaatacttatctataatcagataagtatttaatcattattaatcaataatagcacggacattaataattccatttgccgactcaatccgctcaataatatcaggtcgaacttcatcatttgtatcaattagtgtatatgcatattcaccacgagagcgattaaccatattttcaatattcaaattatgatcagcaaataatttagaaatatttgctaaaatattaggaacatttttattaataatacataatcttgttttagacattcttgcttgattgactcctgggaagtttactgaattaatgatatttccgttttctaaatattcacaaacttcttcaaccgccatctttgcacaattatcttctgattctggtgtacttgcacccaaatgtggaagaataataatattttcttgtccaattaattctggtgcagcgaaatcactaatatatttattaattttaccgcttgcaacattagctaataaatcttcattattaactaaatcaccacgagcaaaatttaaaattctgacaccggttttcatctgtgcaaatgcttctttgttcatgaaaccttttgtttctttagtactaggtacatggattgtaatatagtcacattcttgataaatttcttctaaagaagctgcatgacgagcatgcttagataaagcccaggccgcatttacgccaatatacggatcataaccttttactttcattcctaatttaatagctgcattggcaacatttactccaatagcacctaagccaattacccctaaagtttttccttcaatttctggtccaacaaaattacttttacctttttctgctgttttagcaatatcctgatcgtcttttagaccatcaatccaacgaatactttcaacaatttttcttgaagagagaaataatccacataatacaagttctttaacagcgttagcatttgctcccggtgtattaaatacaacaattcctttttcactacaatcatcaagtggaatattatttactcctgctcctgctcttgcaatagcttttagattttccccaaaatcatattcatgtaaagaagctgatctaaccaaaatagcatcttcattagtcatttcttcgctataagcataattttcgtcaaatccatctaatcctactttagatattttatttaataattttatgttatacataattattctcctatttgttcgctgcttcaaaatctctcatgaaagcaactaatttttcaacaccttctaatgacatagcattatagatagatgctctaattcccccaactgaacggtgaccttttaaattagtcatacccgcggcaatactttccttaacaaacttagcatcaagatctttgtttggtgtagtaaaagtaacattcattaaagaacgattatctttatcactatgtgcgatatagaaatcactactatcaagataatcataaagaagattagcttttttaatatttctttcttgcataacttcaagtccacccatactatcgatccattccaaaactagtcctaatacataaatcgcataagccggcggagtattatacattgaatcattttcaatcatcaatttataatctaataatactggtgttgtcgcagcaactttttgtaataaatcttctttaataattgctactcctaatccagcgatccccatatttttttgtgcacctgcataaatcattccaaactttgaaacatccactggttttgataaaatatttgatgacatatccgcaattacaggaacaccattagtttctggaatatatttccattcagttccgtaaattgtattatttgcacataaatgaacataagatgcttcaggatctaatttcaattcgtcttgagttggaatatgtttaaaattgttttcacttccgtcataagcaatattaatttccccaaatttttttgcttcggctgcagcttttttactaaaagctccagttacaacataatcagctttaccattttttaataagtttaatggaaccattgaaaattgttgtgttgctcccccttggataaacacaattttgtaatcatcagggatattcattactttctttaataaccattttgttttttcaaaaatgtctaagtaggaagaggatctatgactcatctccataacactcatcccactattttcatagttcaacatttgtttagcagctttttctaaaactggctcaggcaacattgaaggacctgcagaaaaattcagtactctcttttcagtcatatatatacctttcctttcttgtatgtgaagtctattatattgtatacaatctaatttgtaaagggattttgtaaaaaattgtatacaattatacatcgtttcataaaaaagctatttttcttagtaattatcagtttcattatatgctggaacatttgataaattcacgatattttaactacatttacgataaaataaattgaattaaatacatttctaagatatgatgaaaaggtacatataggagagaaaaaatgaaaagaaaaaaactaaaattgaaaaaacaagcttactttgttattggtggcctcgtcatcctagctgcccttatactataccttattttatgtttagtaacagggggagacaattttgtttcaaatacaactatcaatggtattaaagttggtaatatgaataaagaagaagcacgtaaggctatagaacaacaatatcaaaatgatttaaatccccctactttaactttattactcgatcaacaagaatacccagttgatttaactgataatcttacattcgatagtaaaaaagctgtagataaaatttctaaacagtctaatagttcattcttcagacgaggatataactatttgtttaatcatgattatacagttggggtaaaaataaaaaataaagatcttttaaatgaaaaaattactaatagtcaaattctaaattatagtactttgactcctactaactatgaacttaaagatgataaaattattttcactaaaggaaaatccggtaaaacagcagaattagaatcagttttcaatacaattaataaggcattaaataattatgattttaaagggaaaattaaatattctccagtagaacataaacttaatgatgaagaaataaaactaattcatgaaaatttatcaaaggaagctaaaaatgctactctagataaaaataacaattatgaaatcatcgatagccaagtaggtgctaaatttgatttagaagatgctgttgctaaatacaataaaactactgaaggtaaacagtttaccctaaatgctacgatcattaaacctgaaataaccaaagaaatgttagaacaaaatttatttaaagatgttttaggtgaatatgcgactaacgtcagcggtacttcagttcgtaaaaataatgttaaactttctggtgataaatgcaatggagttattttattgccaggtgaggaattctcttataataatgttgttggcaaaagaacgaaagaaaatggtttcggtgaagctgcagcctatttaaatggagagactgtgcaagaagttggaggtggaatctgtcagacatcatcaactttgtataatgctgtattgtacgctaatctaaagattactgagcggactaatcatacttttgtttctggctatgttccaatcggtcgtgatgctacagtatcttggggtggccctgattttaaatttaaaaatgaccaggcttatcctattaagatcatcgcttcttatgaaaatagtcgtctaacaactaaaattttaggtactaatgttaataatattcgtgttgagctaaaaagtcaaaaacttgcttcaactaattataatactaaatatgaagacgatcctacattacccgaaggacagacaaaagtaaaacaaaaaggaactccaggtagtaaagcaaaatcatggcgttatgtttatgatgctaatggcaatttaatttcatcaaatgaagaagcatatagtgtatataaaggacatgaggaaattattttaagaggtactatgaaaataactgaaccagctacgcctgcaccaactgaacctacaactccagcacaaccagaaacgcctaccattcccaataatgaaacatcgtagaatcttaaattaaatactggtggaatttttccacctttttctataattaaaaagattattacataaaataataatctttttaattattttatttttgtgcaatcttccacttttttaaacaatactgatatatctcttgttctgaaatcattaacgaagcactggctagatttatttccatattcttaccattcttttcaagaattatcagaaaataaaaaggctcatggtgcagctgaatttccgcaaccttctgccataaaatcacttttttccatagcctataagaagtgataccatctttatcaattacaaactttttcattccaaaaaatatcaattctaataattcaatagttccaactattacaattaccaaagaaaagaactctagcaccccaaatataaataaacaaaatatcatgatagctgatgatacattcgaaataaatcctgaagctactattggaatgcttatcataattaatgaaaatggaattatggataaaataagaatagttgttaaaatcatatcttttctaataataattctttccacttcttttatcctttccaccattcaagtcattacattaaaacatactttattttctgtaaacttgaaaataattaaatattgtttacgaatacaaatatcagggtttgtattcgagtgttttgtaatataaagtatttctttttaggaagcaaagtagactttttctcacatagaatatataattaaataaacaaacttaaataagatattttcttaattttcacaaatattatgattgaaaaaaacaggaaaaaaggtctacattttttcctgtttttacttaaataactttatttatattgattcataatcctttacccatctagtaaaggtatgattatttgtacttaaacgacgcgaagcttcagctttgctgattacattttttcgccataaataataaatttcttcaaaatcgtcgggaatcgttaattttggtcttccaaatcgtacgcctctacgtttagcttcacgaattccctcggcttgtctttgacgtgtattttcgcgttctatttgagcaacataagaaagcacttgcaatactaagtctgcaataaatttacccgtaattccatcatgcttttcacgtgtatctaataaaggaaaatcaattaccacaatatctactccgattttcttgacaatataacgccactgttcaatgatttcatcataatcacgtccaagacgatcaattgatttaatgtataaaatatctccctgttttaaaacctgaagaagtttttgataatgaggacgattaaaatctttaccggactgataatcaatataaagctggctccctgtaagtccaacctcttttaaagctgtaatctgcctatcaacattttggtctttacttgatacccgtatatatccatatttgttatattccattctatattttcctcctcgagtaaaaattatggcatagggaaagttagaatgctataaatggctaattatttagggattctttgcatcttacatcgtcagcagtgataaatccatttttataatcgtaatacgataaaattaaaacagaaacaataatcaacaaattatcgcttctgtttaactaataaaatttaatttataattataacatcgtcttttcataaatatcagcaatgttagttccaacatgatctggttgatgagcatcacttgctgtaatcatcgatactccatgttcttttaatatctttaacaattcttcgcttaatcccatatctttatgattataacgataataacatcctgtattattttcagcttttacattatgttcaaccaacaaatcagctaactgatgataagttggtgttaaatcataggttggataataattaaacatttttattgtatctggatgtgctaattgcgtaaataaatcagacttaaccaatgaaaaaatcaattcataataatcacgataaatatcatcaacatcaaatttattccataaaatatctttagagaaattcatgtcatataatctgccattaattgagtgtattgccccaacaacaaaatcataattatggttagctaatacttctccaatcttcttttcatgtttaggcacgtagcatacttctaaaccaaatgtaacttcaatcggcaaatctaatgctttaacttcctcaattaatttatcataatcatctaaagtatccttaaatttcattgctttattctctagccattttttttgcaatggctcttcttttaattctgtataaatctcttcaaactctttaaaacgatgtgtgtgatctaaaatttgaatctttgtcaaaccttttttaacagctgcatcaacaaactttaatacatattctttatttagatccccatattctaaatgcatatgtccgtcaatcatctttatcaccccttctttttttatgattatatgcaattcttaaaaaaaagtacagtaataaaataaaaaaaggagccaggggagactccttataggatggatgagtttttgggagagggaatcatccatcatttaagttgtaaaatatatatgaggggattaatatattttacatattattatggtttgtctttcgacactattatcctagcaccgctctatgaattaaatgtgaaccgtataattttttaaaataaaaaaggagccaggggagactccttataggatggatgagtttttgggagagggaatcatccatcattcaggttgtaaaacatatatgaggggattaatatattttacatattattatggtttgtctttcgacactattatcctagcatcactctatgaattaaatgtgaactaatctaaaacaaataattagaaattttatccttcgattatttgatccaaccatgcaccctacaagcattataaattccatcactagtattgcgatcagttatataatccgctttagcttttaattcatcacaggcattacccatcgcaattcgatagaaacgttcatcaaacataacaagatcattataatcatctccaaatactacaacatcatcaatatttccttttatcatcgcaatcatatcaactattccctgctttttatcatctggctgaaacattaaatattcttgttcaaaacgtaatgaacctaacgtatcttttaatgttaatcgtgtttcttcactagctggaatagaaatataaattttataaatattttctaaattatgataatttatttcactatcaattgtataacgtgttggttcttttcgataacctgcttgttttaaaaataacgtatttttactgtatacatcaatactatcaaatggagctattaggattccatagcctaaattttctgcttcatcaataacagccaatgctttttgccgatccaatggtgcattttttactaactgatgatttatgacaagaccattaccaccattacaaaccatattatttaaaccaacttctttaagaaagtttttagctttataataagcgcgtcccgttgcaatagctacaaaattaccattttcttgtaatttatctagggcttcttgggcacttggaacaatttttccagttgtattatccgtcaaagttccatcgatatcaaaaaatatatatttcatatcattcttctccaatttctttaaagaatccataaataacagctccacaaagacttcctgctaataaagcaacaatatatctaaaaggatgcgctattaatggtaatacaaagattccaccatgaggaattctaattccacaattataaagcattgaaaaaccaccagctactgctgaagcaacaatgcaagctaatgttactaagcgggggtctttttgaacaaaaggaattgtcccttcagaaataaacattaagccttttaagtaattttgacaacctagtttacgttcagttaatgtaaatttatttctaaagaaagttgtactaattgcaattgctaatggcggtaccattccgccggccattacagcagccataacatcaaagttaccttcaacaatttgagctattccaaaaagataagcaattttattaactgggccacccatgtcaacagacatcattcccccaacaataactcctaaaattagtttataaacaatatccatactaccaataaatacactaatagtctgatttagacttccaacataaggactaatcaaatatgataaaacacccgtaatcatgaccccaaaaatcggatatattactgttggctttataccatctaaacattctggcaatttacgacaaattttttgtaataaaattacaacatatccaccaataaagcccgctatgattgcacctaaaataccaggactaggcatattttgtagatacatattatttaataacattgcagccccgccagcaagagctactgcaaatccctgctgacttgcaattgcctgaccaataaagccagcaaataaagcaacgatcatcccattaacggttatccccagaatataactgttacttagccaaatactatcataaatttgtttgattccaaataaattataacttgctgctaatgaagcaattgaaatcaatgctcccgatccaataatgattggcaatattttacttaaagcatctgtcaattgggtatataattttcgccaaattccctcattggcagaactactaaccactttatctccttgatgatgataaatttctacattaccatttattgcttgcgacaataactcctctgctttattaattccatcagctactttagttataattacaggccgaccatcaaaacgtgacatctccacttgtttatctgctgccacaataatacatcgtgccttactgatttcttcagccgtaagaacatttttaggccctgttgccccatttgtctctactttaaataatatgttcatttctttagcttttgcttctaaactttctgctgccataaaagtatgagcaattccagtaggacatgcggtaactgctaaaacttcataattagtaccgtcagtttcttcttttactttcactatttcattttctttatcatcaattaatcttaaaaattccactgcatcactagcattaattaaattttctttaaaatcattatccattaacatcccggataatcttgctaatgtttccaaatgaatgttaccaccatcaactggggctgcaatcataaaaaacaaccgtgctggttgactatctaatgattgataatccacaccatctttaactatcattactgctagtccaggtttttttactgctgctacttgggcatgcgggattgcaattccttctccaattcccgttgtactttgagcttcgcgagctaaaataccttttttaaaggctagtttatcactaatatttccagtacccaccattaaatcaactaagtgatcgatcgcttcttctttattagcaacttccccattcatatcaattccctgcagacataataaatctgtaattttcattattcatcctcacttattgtttttaataattcatctattttttcttttgatgccaaatcttcactgaatgcagttgcactaccagtagctgtagcctgttttaaagccgttttgaaatcatttgtcttaatataaccgtaaataaatccagcgaccatactatcacccgccccaactgaatttttaacctcacctttaggagcagatgttatatgtacatcattattttgatcgactaatactgctccatctccggccatcgaaactaacacatttttagctcccattgtttgtaatttcttagcataaacaacgacatcttctttatttttaatttcaacattaaaaatttcagctaattcatgattatttggcttaatcaaaaatggatgatgctttagacagttcatcaataaattattagttgcatcgactacgatcaaaacattttttgattttacatattccataattttttcatatatatcatccggcatactgcctggaatacttccagataaaactagaatatcaccatcttttaaattatctaacttacctaataatgcttgaacttgtgcatctttaatttgtggtcccatcccattaatttcagtttcattatcagatttcatcttcacgttgattcttgataatccggcaacttcaacaaaatcagtttttaatcctttagcttctaatccctctttgattgctttgccagtaaatcctgcgataaatcctaacgccgtacttttttcacctaaagtttttaaaacgttagaaacattaattcctttaccaccaaaaaacatgttttcttgttttgttctattgacaattccggtttcaaaattatctactttaattacataatcaattgctgggtttaacgttactgtatatatcatcttaattttctccttaagttaatttttaatccactcttagtatatacttaggtgtattctccgtcaaattaatgagtcaatatttattttcaaataaagaaatttaatcttataattttaattatttaaacttaataataattttaactccattaacaagcttcttacaaaaacaattgaaatcaccttatatttatgatatcttttacatagttagtcattgctaactatgtaaaaggagtgattatatgccatcaactgcattattatttgaatctaaacttgttactttttgtagtcctactttattaaaaatgaaagctggaaatatttttaatattagcaatgagttcaatgaattagaagagtgtttaaattattacaaccaactatgcaatcaaagaggaatatacatttcgattattcatgaaaataataattcaaaaatgatttatgtttatcaaaaagaaaaattaaataacctttttaataaccataaatttagagctgttctaaataattatcattacccttatcaagatatcgacagtctaataaattggctaaagattagaatgaatagtagtgaatttcctcatgaaatcggtttgtttttggggtaccctttgactgatgttaaagggtttatcaacggtgctgattataaatatattggatattggaaagtatatagccatgttccccaaaccctctgtacttttgaccgatataaaaaatgcacacaagaattaaaaagacgtttttgtcaaggagaacgaattgaacaattattagcccatgtttaaaataaaaactatgaccggttattttgacatgagtcatagcttttataattatattaaaaatcacaatttcattttttttcgatatgcagttggcgtcattttatattttgctttaaatcttttaaaaaaataactattattctcgtatcctacagctgtgataatgtcattgattgatagttttgtatccctcaatagttcttcagcacgataaaatttacgactttgcaataattctttaaaattccgttgagtttgttgtttgattagcttgcttaaagcataaactggctgatttagaatttgtgcaatttcattcaaagtcgcatgtttgtaattatcggtaatataatcaacaactgtctctactaaaagttcttcaaattccttggtcgtccctttctttgttcgagcaatatatttagtcaagtataaaaataataatcccattgtaatttgatgttcgtgacgaaattcagattcactctgcaataatgaatagattatattttccattagattttgaatttgaagaatatcagcaactttaaacagtaaatattcgccacgacattcatcttgttttaaaatatttattaaaaaatcaccaataatattattatatccaatcattgtataaaccatatcaaaaaactctggcaaaatcattaaattaatagcaatgtcatcagctgaagctttttttatttcatgccaagaatgctgattcaataataagatttctccttgtcgtaaaactacttttttattatcaataatatgagtaattgagccttggcatacatacatcatttcgatatagttatgacgatgcaaggggaagtcagcaaaacgagtatgggttctaactgaaatcaaagtttgtttatccagcatttttttactttcaacaataaactgatcattaccagtataaattgatttttgaatatttactttattatttaagattgcctgttcttcagcagttattattttcagctgttccaaaaggctttgattcatatttatcttcccccttttatttatgataactttgtaaattctaaaacgcaatcgatttaaactaaaataaagattatttaaattattaattaaataatctttattttcaaacatgattaaccaccagcattaaaagagaggttttaatcaatgataaataactggagatatttttgattgttggtcaaaaaacacatagttaatcaagacaatattttatttatcaaataaaaatttttctggtagaacaacattaaaatctttagctaacaatctaaaattagctggtgagatagtctgtaatttagttgatgacatcgataacattttgactaaaattgcagctgatttttcaactgtatgagcaagaccgaaagtaatatcaaagtcgcttcctgcacaaaagataccatgatgagcccagattgccacgtcatattttttcattaattcagatgttgcgatggcaatatcacgacctccaggaaccatccaagggactacccctacaccatcaggaaaaacaactggacattcagtcgccatttcccataactcccgagtaaatatctcatcttttaatggtaaaataaatgttaaagcaattacattagtagcatgacaatgataaatgacacgataattttcattctttaatttttttacttcatgattcattaagtgtgatggcaattcgctagttggttttccaccattaataagtccccaacaaatcttataattctcaccacgagtatcaattttaataatacctatactatctaatggatcaatatcaacatttctaaaaaatttacctgaaccagttactaaaaaatattcattagctaaagctggaacactcgtcccaatcggataatcctcagttgtttcatctaacccttctcttattaaagcgatttcacctactttaattcgataggtaagatttccaccatttcgctcatgccagcctaacttatagccgtcgctgcacattctcataaaaccttgaataaattgtgtttttaagatttccattattttactcctattttctatttactaaaacttcatgttcatattttttaatttctttaaaccactctagaccttcaggtacttgagtaattttacaaatatagttccatacatcacccaatgggtataatttcaattcttcttgtagcgccatgatttttgtaaaatcaccttcagactgcatttttttcaaatcatcaaatgggattaataaggcatttaataaagctttttgcatatttctcattcctactgtccaagcactaatacgattgatgcttgcatcaaaaaaatctaaaccaactaatactcgatctaaggcatcgttacgaacaatttctttagcaatctcttttgtttcatcatcaaataatacaacatgatcactatcccagcgaactggtctagttacatgcaaagctactttttgattaaataacaacattgcagatagtttatcagatactacttcagtaggatgataatgtccattatccatcagtggcaagattcctcttgtttgagcataattaatcgtaaattcactagacccaacagtatacgattccatcccaattccaaatacttttgattctaaacaaaccaatactttttctttatcataatcaattgataaaatttcatctaatgattccataaaatgttgccgtggtcctaaacgatcagcgggaatatcttttaatccatcaggaatccaaatattcattagacatgggctatttaattctttagcaaaatattcagaaatacgaatacaagccttacaatgtctgatccaaaattcacgaatttctttatccggattagataatgttagaccctcagctttaggatgagaaaaaatcgttggattaaaatctagccccaatcctctttctttggcaaactctacccatttaataaaatgcttaggttcgatttgatcacgatctaccacttcaccattttcaaaaatggcataactcgcatgaagattaattctatgtttacctgggactaatgataatactttatcaatatcagccattagttcttcgggcgttctagcctttcctggataattaccggttgtttgaatgcctcccgacaacgtccccgctccatcaaatccaactacatcatcaccttgccaacaatgcatagaaatgggaaaattaagtaattttcttattgctaaatcggtatcaacaccaacttttttataaatttctctagcacttttatatctttcaactacattcatttttatttttcctccttatactttttaatttcaaacgaatttttaatacatttacgtgcttcaacaagtgaagcaaaaacttgattattaagcatttgaacaactatattaccagttgcagttgcttctaccggtcccgtataaattactttaccagtagcttttgctgttaattcatttaaatactcagcattcccgccaccaccaacaatatagattgcttcatatttttttcttgttagcatttcaatttcttcaattgtagctgcataacttattgcaagactctgataaatcacatttgccagttctccagcagttttaggtatcggctgattagaattttgacaataatcttggattgctttaatcattgaatctggtgataaaaaacagcaatcatttacatctacacgtgaaggaaaattttgattggcttttgccatctggcaaagctcattaaaacttaacgtttcttctagctcacgacgcaatgattgaatcatccaaagtcccataatgttttttaaatatctaaaacgatgattataaccaccttcgtttgtaaaattagcttgcatactctccaatgaacaatctgcaatatttcgttccattcccattaacgaccatgttcctgaggaaatataaataaaatcttctcgaagagctggaacgcttactactgctgaagcagtatcgtgactggctgtggcaataacttttgtatcaaaacctacactttcttgaacaatatctgttaaattacctattatggtgcctggttcaatgatttctttaaacatagtttgtggatatcctagctgttcgattaattcacgatcccaatttctagtatttgaactcactaattgagtagtcgaggcattagtatattcacaaacctgcctacctgttaacaagtaactaaagtaatcaggaatcatcagcatcgaagaaacttgggttaaaatttcaggcgtatacttttttacagccattaattgataaagtgtattaaataactgtttttgaattcctgttcgctcatacagttcttccgccgaaactattttatagacttcttgatcaatattgtcagtacggtgatcacgataagaaatagcattgccaattcgtttaccatgcctatctaaaaagatataatcaactgcccaagtatcaattgccatactaagtggtattttatctaattctttgcattttttcattcccgcaatgatttcatgaaacaaataatcaacatcccaagataaatgctcatcaatcactctaatattattttcaaaacgatgtatttcttccaaaacaagtttaccattttgataacttcctaaaatatgtcttccgctcgaagcaccaatatctactgccaaatagtattccatcttatactttcctcctctattacacccatattataaatttaacctgtcctcattttaaggacgatacttgtctaaaaaagtgtctttatttgcaaaataaaatagaaaggccaaattacctttctataaaaattactgttgttaacattaatgaatgtaatttgaaattaaattaagtttttatctctatttacaataacctcatcgtcaacatttttcgtatagaacttgagtgttcccgtgattcccattggttcaagtgccaaaaactgtgacattgcatcatgctgattacgagctaatgtgttgataacaattatttcaaacgagttttcaccaatttcaagatattcacttatatcaaataaatattctggagctattttgactcccgctaactttccattaacgattacttcaacaatttcatatgcttcactaatttctaataaaacatctttagttataaatgaatatctaaaatgatacttgacagcacccgaaaaacacggataacgattcattaaattagtgtttaaatcagctttaaaatttactcgatatttagtttcgttaaatgctcttaaagaaatctcaacatcatttacatttcctaactcactttttttcgctggtatcaaatcattactcttaccacttactaaaataagcgattgatatggtgctaaatgcagattaaaaatctgttgctgcccttcaattttactagcaaatttataagtttgattactaaaggcatcatatatcattaatgattggtctgttttaagcattatctgactattaatatcagaataaatactttcattattaaacatatatatatcaccatcatcatgttgataatgataaaaaactagtttctcttccatatgatcaattaaaatttctgagtaatcatttagttctctaggtaattcttgaagtgacagcactagtgcaccttcaacttcctcatcttcaggaaaagcatcaataaaaataactttactttttaagcgcttgattgtctgtaataaacaatctggtaatcttttagcatacggaactactaagacttcaaaatcatagccattgatttgataaacatcttctttaatcatcgcttccatcaaataatcttcactaataacattgcaatcaatttgattttgttgtaaaacttttaatactttttgaattaacatatagtccccagaccattctgcaaaagcatgatataaaactccaactttacagatttgatgtccatcactcattaaattacataatcggttagcatagttagcaaaataatgaaaatatggatattgtggattatttccatgtgcataaaaatgcggtggacaatcccaatcaggaaattccttagggtcaaatgcatgtggcacaattaaattaactccatgactaatcatatgatcagttatccacttcatcattttcaatccttcaacccagccataagctccaaatgcctcgcacatcaaacgaccatttttatttttatctaattttgctgcagaagcacctaatttacacagtgcataatgataaaattctccatcactgccaccagtcgaaaaagctgtgtgatgataatccattccaggaacaatctgtcctccgataatatcgatccccgccattgtttgaccagcaatgctccggaaatagtgacctgccccataacctaaacggctatgagcattattatcttcaattacatgtccaacatagtcaatttctttttctttacaccagtttcctataacctgactaaaattttcactatacaaattagaaatgatattcatataagcatagcgtaccatattagctgtactgctcatcccttgaaataataaaacaaggttatttaaatcaaaatctatctcctttaacttcattaaaacattttcattccatggcaaaggcatattataacgaccaattgaagcgttaggtcctttagtattaccaaaacggggttcatcagaaaaaaaaccaacgatagttttaccaaactcatgataataatgatcataatgcttttgatatacttcatcaatcaatacttgagtggcctcttttttcatcggatctaagtattcttccgtaaccgcttcatctcctaccattgttacatataaaacaaaaatactataattaacattattttctaatgatacagtcaacacattatccttaacctgatttgttatatcaatcaaatcagtttcattaaaaccatcttttacagaaatatcattttttgctaaaacaactctaaaaatttgatcctgctggtgccttttattattcataaaagtacgcatatcaacaatcggtttcaaattaagctgcgcaaacttttgattccccgctatatcataacgacgataatttaagtatcttttcctcaatgcttctggtactttaccattggcataacctgttggaaatctagcatcgtctaagatccatatcttcatatcattctctttagccttttcaataataaaatctaaagattgccaccagcctttttctaaaaatgctggatgaggtcttgattcaatacaaaagtcattaattccctgctctttcattttggtaatatattcgtcaattttattattagattccccatgttgccaaaaaaaaggaaataaattatgatagctggaactatttaaatttttttctactactctcataaattcctccttaattagctatacatctaatcataacactatctaaatcaacattactttcaagattatctaagctgatttgatagtcactagaatttgtaactaccatcattgtaatcatattaagtccactttttaacatatacgtctggtcaactttaataatcggctcaccttcaaatactttttgcccaatctcttttattttaataaaaccagcaccatttagagtaaccgtttctagaccaatatgtaccaagatttcaacaccatgtgtgtcacgaatgccaaatgcatgtaaagtatctgcaactagaatcaactcacctgtaaccggtgcacaaatatcactaccactaaatttaaatgcaacgccttctcccattaatttagttgcaaaagtatcatcaggaactgattcaattgagacactttttccaaccaccggagcttttatttcaatttgttgtttcttttttttaaatctaaacattttttctcctcatagaactaatcttctaggaaacagaagattaattatttatttttcaggatcagcagcaaaataagtaattattgctgatactaccaatgcaatcaaagccgtaataataaaaccataaaaactaacatcaattccgttaggattgatcatcgctggaattctaaataaaccatcaccaccaagtgaatacatttttccacctaaagctcctaagattccaccggcaattcccccaccaatccatgctgctacaaaacatttgatttgtggtaaagcgatagagtagattgttggttctgtcactccacataaacatgatgccatatttccaaatcctaatgagcgtttctcaggatctttcatcttaattgcatatcctaaagaaacgccagctaaagcccaaactgtcaatcctaagattgcattgattggatcatagcccattgtaaataaattatttaataatactggaataaaagcactgtgtaatcctaataaaaccattaactgccaaaaagcaccaaacaaaattcctcctaatattggactaaatccaaatatcgatactaccgcagttgataaccagctagaaactgtattcatgactggaccaatagctagccagctaagcggtactgtgatcattaaaactattacaggcacaatcattaattgcaacattgtcggaataatttttttagcaaaatattctatttttgcagcaataaacgaagctaaaataattggtaataaggtttgactataagacatatttgtaattgttaagcccataaaatgatgtgctgtatcccctgctaaagcatttactaaatccggatataacagtgctgcaccaattgtcgctgttacataaggattacatttaaataccttaccagccgaaaaaccaacaatgattggcataaaatataataatgcatccgctgccgcatataaggtcaaataatttccatcagtttttgtcatccagccaagggttacacaaatcgtcaatattcctttgataatcccccctgcaaccattggccctatcattggcataatacatccactgattactttgaaaaaacgattaaacaaattgcctttttcttcaactttatcctcagttgctttttcatcacccttaaagcctagttcttgattaacaaatttaattacctcattaacatgggtaccaataatcacctgatattgacctcccttattcataactccttttacatccttaattagcttgacttcttcactatttggtatactatcatcttttaatacaaatcttaaacgggtcatacaattagtaacaccattaatattttcttttcccccaactgctctgattacctctttagctaactgcgtgtaatctacttttttagccataactacatctcctctttaaaatatttttacttgtcttattttcgacatattcataatagcaagttaaacggttacaaataatatctaatcttggcaatgatattatcctattttgcttagcgaagattgtgattacgataaatactaggtgttattttaaatttttccttaaaaattttatagaagtacgtaatattttcatagccaacttcctgcattatttcaacaattggcaaactggtagtctttaaaagattggccgctgcttttaaacgttcttcttgaatcaactgtttaaaagtagagcccgtatgttctttgatcaacttacaaatcttataatctggctgatgaatctgtttagctaacactgataacgatccttcttggtaattaagtgtaatatattttaaaatagagataacaactagtttattataattattactctcgtatgtctcaatcaagtgtggattattcatcaattctgtcaacaataatcccactaataattttaatgtaaaactatgatttaattgttgctggtatatattagttatgattgcctcaatatgattacggacaatttcattattactaaccttaaaaattaaatattcacccttattatcatatgaatacaaagcatcaaaaataaagctaaaaacctcgttttgttcttctgccatacctgataaaaattcaagaaactctggtttaataataaaattaaaaataatgtcattttcattagtgtatttaattgcatgttcaatattttgatttagtaataataattctccttgtttaatcacaatctcttgatcatcaattatagtaaccatttcaccaccataaacatacataaactctaaataattatgacgatgctttggatattcacaaaaacgtgcatgtttgcgaacagcaaactgctgattagcttttaataatttatcagcatcaactacatttgactgttcacttataaaaatacttttatcaattcctacaaaaccatttaaattattaatttcttcatcactaaaacaaactaatcgttccataatatcttctctgatcatttcatcacctctattagtaaacgctatcatatctatactttatattctaacaatataaaaataagatactataacgtctatttagtaatttactgacgaaactttagttttagtgatataataaaaaagataaggaggaaaacgatggatagttttaaattagatcattttttaagaacatatagtcgaacagaaatcaaacataaaaatggatttgcaactcaatatgcaactaaaggtaaatatcgtttaatcaataatatctatcaatttaataccgataatgtgccagactccgatactattatagtctataaaaatcaacgctttgatgatgttccaactcacgtccacgatcatattgaaataaattatatgtactctggaagctgcagccaaattatcgatgggcatgaagttattttaaaaaaaggacaaatgactttaattgataccagaacgccacatgcaattggctatactgatgaaaatgatattttgattaatttcattatcaaaaaagattatctaaataatagtttcttttctaaattaactgataataacttaattacatcatttttcattaatgcaattaatcaagataacacagatttaaattacttgatctttaatacagaaaataatcaacgattgcaaatgtttattcttgaatttatctatgaatacttttatccaaccttaaattcaaccgaaataaaaaaaagtctttttgtcttaattatcttagaaatgatcaatactctagatacctctatcaacttagaatccattactaaatccagtacaatcatcattttagcattacaatatttagaaaaaaatttccttacttgcagcctcgattcaacagctaagtatttaaacatcaatccttgttatctaacaacattattgaaaaagaatttcaattattcttacaaagaattaattattaaattaaaaatgcaatacgcatcaaaactgctgctcaatagtagttattcaattgaccaaatagctcatgagtgtggttatcaaaatctaagtttcttctataaaaaatttaaagaaacctattattgtttaccaaaagaatatcgtaacagaaacaaaaaaagatagaaaaatagtgaggttaatttcaaaatttctatctttttaattttattaacaaacttttgatttcatctaaagatttgttctttaaaaaacatctctgattacttttaatttatacgctgtcaattaacttaatgataatctggttatttttactaatcctttttatctcttgatatctattattaattttaatttgatagtttactttttttaccggaactactaattcccaattaatttcatgaccacatcgatgccaagaagaagtaatctgtccttgtttagtatcaagttgacaagtaaaatcatttacttttttggaaaaatagggattaaatactatatgatcaaatccaactgcctgatcagtaatctttatacctgccaatccttgataataccattgttgatagcttgcaaacattgcatgattcaatgataaatgttcaccaacaaataattctgctaaaacctgattaccacttttaagcatttgttgataacttggtgcctctttacgcaataaccagttttcgattacctcatcatatccgtatttagataaaatttcataacttagagccatcgcaaaaataccactattaaagacataatcatccttttttactttctctacaaataaagcacataattttttaggatcatccagccctaattcaattgcaaaagcataaccactttgacttccttcaccaaaactaccatcagaatttttaaacttatttatcgtaagtatcttgagttcttgatatcgctgttgataaaaaacagtatcttttttaatcgcttgataaattaaaatattatagcgtaaaaataatagtaccgtgcagtaacctaatagaagtttatccggtgttggtttgcgaaattgaccagcaattaaaatactcccatgatcccctaaacaacactcaactagtttattcaaattataatctagcaaataatccaattgtttttttaagtatgggtattcttgcttgagtaaactcaaatcaccataatactgataatgtttatagacaagatatggataaactaattgccataaaatcggtccctctccttttgctgtaccattagattgaattcccatatatggagcagtttcaggaattccacccatggcagtttgttcaaatcgaaaatctttaataatctttttatataatttatctaactcaaaagtatatagatttgaagtagcaagggctaccatatcccccccatagcctaaacgctcacgagcacaatcctcaaatgttccatgaacattatttaatttagttcttgtggcagcatcatataattgttgtaactcttgattatcaactgtaattttggcaattttttttaaatccgtatgcacatacgttgcatagatctgttgcaactgggtcaattcaattccagtaatccgaacaaagcgaaaagaatgatacgtaaacttatttgtaaactgattatacccctccttacaaataagacgatctgtttgaatcgctattgccggagccccggtccctccggcaattacatgttcaccaattcgctcccctacactcccagctaaacaagtagaatagactaaatgattgtctaccatggcttcactatactgcaatactatttcttggtttttatgggctgtacaagcaaaattaataaaacctgaaatcattttaccaaaatcaacgattatcccatcactttgattaatgaatgattgtggtaatatatcaccacatcgcttgattttaggaatttcgcttaaaactaaattacgtttacaatcatctatttgaacttgggcataataatttgcttctaaattattatcgaccgtttcgccaagataaagattattaaaaaggcgtttaccatttcctaaaatccagcttgaatcactagttaaaatcactttatcatcgttaactaaatccaagataaatcgtggctgccccacttcagctaaattatttcgtaaattgtacttaccaaataattttaatggtgctggattatacatcccgttaccaagttctacttcaagaatattagtaccaatctttaaaaattgacttacatcataaacatcataatagacacactttttaaaatttgtccaatcacaattaagctcatcctgactaattcgacgtccatttaaatacacgattgcatatcctaaaatacctatatagatataactgctgttgatttcatttacaacaaactcttttttcatcagcggatttggctgctttaaataatattcgttatcttcttgcccataatcaatctctgttcctttgatccaatagccgtgaaattgataatttgacttttccatataaagttctatctgtacgagaaaactaaatagtttcttgtacagatcctcctttattttctaaagcagcttcctctttaatcaattgattatcagcgattcgcacaaacggcagccagatcagtaccactacaatcagacaaacaatttgtaaaattgatcctgcaatacttcccgttgctaaatatccactaataactaatggtgttgtccatggaacttgagccaatcctgtacaaactggcactaagccagtcgcaaaagcaacatatgaaattaaaatagacactacattactaataataaatggaataaaataaattacattcatcattaaaggaatcccaaataacgtcggttctcccacattaaatatatatggtacaccagcaatttttttcatttctttataacgtttactttttgcaattatcacaatagcaataatagcccctactattccaattccagcaaaactatcccaaaaactttggttaataatattaacaggtgtccctccagccattgaaacagttttatttgcatcttgtagtacttggaaaattggtgtcattacaccattaacaatcgaatcaccatgaattccaaaaaaccataacaattgtgaaaacattttaacaataacgactccaatcaacgaaccaccaactttttgtaatggtacacctaaaataaaattaaaaacagctaaggcactaccaccatcaaatgcatcaatagtcaaacgtaataaccaaaaaataaagattactacaaatgatggtataattgattcaaatggtgctgctactgccggtggcaccgctgcaggcattttaattttaattcctttatcattaataaatttataaactttagctgaaatgattgaaataacaatagataaaaaaattgtttgtgcccctaaataagtaacactaataaaattaccagtatcattagcaccaaatggtacaagtaacataaatgccaccacagaagtcattgttacttgaattccattaattcctaatttatctgctaatgaacgagaaatcgacaataaaactaataaaccgccaattcctaaacttgcatcattaactaatgctaacttaccttgccatactgcagcctctaatcccgttattgaagaaacaaaatctgtaaatgctggaattggaaaaaaagcaataattaaaaagattgaggcaataaatgcaaacggcatatatgccaacattccatctttgattgcattaatatataagttaccacttaacttaattgatactttaccaagtatttcttgtaatttatccataaaagtgagttcccctttcatatttatatccactttcgtaattgattggccatatcactaattacactatcattataagtagttgaaagcgcttcgacaatgtcatatttcgctttatagactatcaaaattcgactaaacacagtatacttaattaaaaggagttgaaattatgaactatcaagaattagaaaaagtattacaaggaccccttacctatactaatacaagtgacaaaaaattaatcgaacattttcaagaaaagtttaaaatggttccctataataatgattttttgtttatttttcatcatgaacgtgaatttgaaaacaaaaatcatattatttctctacatcaacgaaatagtggacgagtaccaatgcatatttttcattatatcgttattacctatgtttactcagggacaatgattataacagtagaaaatgatactgttaccttaaatgctggagatgttattatttttgataagcatgtcccccatagtgttgctccaaccagtgcaaacgatcttggagtcaatattgttttaaatgaaaattatttttctaaaaaatttataaatcatcttcctaatgaccaattgatttctaaatttatgattgaattaatgaacagccaaactaatcataatcactatttacttttctataccaaaaaagatcatctaattacaaactgtatccaaaatattctttgtgaacactttgaacctgctgtttgttctgatgatctgattgataactttattatggttttgattactcatttagttcgtaaatttcaatataatacgaatctaactgtcagtatgtttaaaaatgaacaactgatggatgatattttaaattatatccacagccattataatgaggggagccttaataaaatgtgccatgattttggttacgatccctcatatacaagtaaattaatcaaacaattttcaggaaaaacttttaaacagctcgttaatgaagaacggatgaaaaaagccgctattttacttcaaaatcatgaactgcccatttatgaaatagcccaccaaatcgggatcaataacttgacttctttttatcgtagatttcaagcatattaccagtgtactcctcaacaatatcgggatcgttacgactaatctcttataataaaaacatataaactagactaggtattgtgaatattgctaacatcgttgatataaaaactgtcttagcagctaaaaattcatcttgaccattgcttcgagcaaataatactgctccgttagctactggcattgctaaaataatcaatgtaattccacgtatcatcgaatctttgataaacaataaaataactggataaaacaatatcgggataattaaatcaattaataatgtaaataagtacactgtataatcactaaatatatcttttaaatgatatactgataatgttgccccaataactaacattgctaagggagtagtcatcataccaatagaattaatgggttcaactataacataagggaaagtaagcttaaatgtataaattaatacagctaatatagacgatattacccctggtgaaaatatcttttttaagtcaaatgaagtcaacttattttcaccataattaattgcaacgattcctaatgtaaataatgataaattaaaacccatattaattatcgctgtagctaaaattgcttcacttccaaaaattgattgcattaatgggaaaccaataaagcctacattagggtacatgatcataaacaaatataaaccttgattagttttaattcgtctaatcattaaaaatgctgctactggtaaaataataactaaaatgaacatagcaataataatatcttttaaaggtaaagctggagcatctattgaattcatcactgatgataaaatcatacatggcattgtgagatttaagaccagattagttaattgttgtacaaacatccctctaaatagtgacgtcttgccaagaagatagccaatcccaattaaaataaataactgtatcagttgaatgataactacagtaatatccattatttattacctcattagtcaagtaatgcttcttttttagcttgttcttctataaatgcctgcttatcctgagctttaaaaaatggataatagatcaaccctgtcagaagcaataaaacaacttgtaataaagccccttgccagccactgatcataaaccctgaaattacagctggaatagtatatggcagattgattccattgatcattggcactaatcctaaataaattgctaaataagttactatccccactgatacattcgctaaaataaagggaatcatcatcatcggatttaagacgattggaaacccaaaaataattggttcattgatattaaataaagatgcacctattcctaattttcccaaagctctatattgatcagatttcgctttaaataagcataataacgttaaactcaaagttgcccctactccacctaatttaacgaaaaaagaaataaattgataattaacaatatgcggcattgctagaccagcttcgaaagcagcaagattttctgctgattgagcaaaccaaattggattcatgacagatgaaacaatacttgaaccatgtaatccaaaacaccagatcaccgcttcaactaaaaggactaagatcgtggctggtaaagttcctcccaaagattgcaatggctgttgcaaaattgtaaaaacaaatgtttgggcagaaccaaaatcagtcattgcaaatcccattcttaaaatattaaataataaaattattaaaaaggcaggaataactgctgcaaaagcacttgatacattttgaggcacagaatctggcattttaatagtaaatcctttttgtacgcaccaacgataaatctctactgcaagagctgctgctatcatacaaacaaataaaccttgcgcactaaaattgtctaacggcaatccctttacattttcaacagtaacaatcactggtgtcaataataaaattccaacaaaagataatgcaatagctaatttactatctactttataataattagctaatgatttagccataccaataactacgaaaatagccattaatttaaaacttacttgatacggcaaatagaaaaaatccatccacccagcaccaaaggtgctttccataaactcagtatatccattgaaaggtaaactagtgaataataagaaaatagaccctgcaattaaaattggagttgatccaaaaaaaccttccttaattgcacttaaatatcgatttgctgtcattttttgtgcaattggtgcaatcgcatcaccaatcttatccataaaacgatccataatatcctcctaaatatggtttttaattaatatatttttatttgaaatatctttgactgtagtcttaaacaaacgatcttgtaaagtttctttttttagtagcagcattcctattgaaataagcgaaagatacattgtgatatcattactaatttcaattaaactataaccactaagcaaacttaatagttgtgcaactaaccttcctcctgaagttaaaataaggagcacaaataattgacgtttaactaaaaatttttttcccttattattaatcttaagatccattagtctttttccgagagtctgacccgaataaatccagcaaggtatatataaataataaaatccgagtaataaaagactgagcaatgctgctatgatggcaatttgatgatttaataaaaagatattttgtgtcatctgctttatcgttattaatgatattattgaaattggcagtgaccccaataatgctccaatatacaaatcgactagaaaagcaattcccctttttaatagtaaactattttgtttcattatttttcatccccttataagaagtgtcataaccatttgaagcaataacttgcttataccagtcaaaacttttcttcttactacgttttaatgttcccataccctgatcatctttatccacatatataaaaccgtagcgttttttcatctctccagtacctactgaaataatatcgattggaccccaacaagtatagccaatgacatcaacttcatctatttcgatagcatcacgcaatgcatcaatatggctagctaaataagcaattcgataatcatcattgattgttccatcttcttctatttcatcgattgcgcctaaaccattttcaacaacaaaaagtggtacttgatagcgatcatataattcatttaacgataatcttaagccaagtggatcaattggccagttccaatcatttactgataaatagggattatcccttgtgactttgatttctgaatcttttgaatacgaagcaattgatgaaaaataataactaattgcaatataatccactttaccagcctgtaaaatttcttcatccccttttatcgttataaaattaccatttaatctctttgcttgagctcggcaagtattagtataatgccccctaaccattacgtcactataataaaaattaggcagcatcgaaagacgttttgctaattcgtcttgcggtctacacgttgctccataagtcattggatactgcaacatacatccaattttaaattccggattaattcgatgtcctaaaattactgctttcgcacttgcaatcatcaaatgatgagaaacctgtaactttacatcaccatgattttctcccggctgataaatgattcctgcttgatgataaggcatctcttgattcattacctcattaatttcattgaatgtcatccagtatcttacttgctctcgatatctggtaaatataacttcacaaaagcgttcaaaaaaatcaattaactttcgattacgccatgatccatatttttgaacaagatagagaggtgtttcataatgtgataatgtaacgattggctcaatttgatatttagctagttcagcaaaaacacgatcataaaattctaaaccagcctgattaggttcgtactcatccccattaggaaaaatccggggccaattgatcgacattcgaaaacacttaaatcccattttagcaaacaaggcaatatcctcttgataatgatgataaaaatcaattccttcatgactaggataataacagcctgattgaaccctatcatgaatttcacggggaactccgtgactcgatcccatttcgacatcagctatacttagtcccttaccatcctcacggtaagctccctcatattgatttgcggcagtagcaccaccccataaaaaattatcctttattttcattaaaaaacctccttactagcttaatataccaataaggaggtcattactatatagaaattaaagagattttaacactgtttaaatttagatcatctcaatattaaaattcatgaaacagtgtttcatttttcaatcccatcattaatgatgggattagtcgaactacgcaacgcttctaaatcttttgtaatcttaattttattatcataattttgatcatagtcttcaagaaagaaaactgaatacaaaatatccaacatcaaatgtgtcgcaagatgggtactaaaatccccaagattatgatataagctttcttttgttgaaatggtcaatttacatgatgctaacttagcaagagtattttcaccaaatgaagtgattgcaataatcggaatcttattatttttacaagtttgagcaattttaattgtattgatcgtttcacccgagtaggaaataataatggcgatatctccttttggaatacagctaacctcatacaattgataatttaaattatttgaaattactacattcttaccaattttcaacatcttttctttaaaagactcagctaaatttaaagctgttcctgtagaaaaaatatgaatagaattactattttttaataaccgtaaagctttttgaagatcatcatgatgcaacaatgtcatagtatctgttactgtatcttcatataaatgtgatatcttatgagcagtcttcatcatcgtatcattacgattaaaaggaaaattagcatcaacctttccatattgttgatcaagataatttatttcttttaaaaattgttccttaaaatcatcaaaacctttaaaatcaagtttcttacacaaacgaattacagtagctggtgaggttaaagttgcttcggcaatatttcgagttgaatatttatgaagttccttacctaaggtcaagataaaagctgcaatactttcttcaccatcagacatcttttcttttaagtttaatttttcaattattaacatttcaatcatcacctttttctaatcctatcatatttaaaccatatattttagttaaatttataataatcataaaatctgatgtctaaaatttaaattattgcgtttattgctatgataaaacaaatcacctataataatattataagactaagggtaaaaggggtgatttcatgttaaaaggtgatggtgatacctatatttacataattgataaaaattataaaattttgtattgtaatgataatgctctacaaaaattcccatgtgttaaagttggtgaattatgctatcatgcagttagagacgaaaaaaagccttgtcatgattgtccattacagctaaatagtaatagtacaagacctattttttataatcgcaaaataaatcaatggcaggaaatcaatagtgctattattgattggttaaattataaagatgttaatctgatcatgataagagatattcaagaagaagataaaaacttgttttacaattttactaaccttaacgcttacgatgaattatttgaactaaatatcactcgtaacttatataaaattctttatcatgttcctaataaatatattattcctccgactgaaggaaaaattaatacaatgatcaatcaaataatcgatgaagaaatgattcaccccgatgatcatgataattttttaaacttttgggatcttccaaaacttcatgaaacgtttagctctaatcagcatcaaattctaaaaggctatttcagaaaaaagaaaacagatggtaaatactgttgggtcttacaaaccgttgtagctattgaaaattcccaaatgaatgatgaaatcatcatgtgttttatccaagaaataaatgaacccccaacttttcagcagcttcctgataaaaaacagttcaatgaactaactggactttatcagacaaattcattttttcaaattgctgataatttattgaaaactgatacttcccatcaatattgtatggtcgctatcgatattgaacatttcaaactatttaatgaatggtatggaattgcagcaggtgatctattcttacgtgcaattgctaaagaacttaaaacaatcagtcaacaattaaggggtattgccgggtatttattaggtgatgattttgcacttttaattccttatcataataatcatacaaaaatgattcttgacaaattaatgcactacattgaagaatttcaagataaaattgggttttatccagccttgggagtttgcctcgttgatgatagaaatatgccttcccaaactatttatgaccgagcagtcatcgcccttacatcaataaaaggaaattatgctaaacgaattgcctactatcaagataaaatgcaattacaaatggaggaagaacataaactgctccttgattttcaaaatgctattgaaaacaacgaatttactttttatgctcagccaaaatgtaatattcaaactggaaaaattgttggggctgaagctctggttcgctggcaacatcctaaaaaaggaattattcctcctaatgagtttattccaattcttgaaaaaaatggcctaattggcaaaatggattattatatttgggattgtgtgtataaacatcttcgaaaatggatcgataatggacataaggcaattcctatttccgttaatgtttcacgaattgatatgtttactctcgatgtagttaaatgtttcaaagatttagtaaacaaatatcaaattaatcataatctaattgaaattgagattactgaaagcgcctatgttgaagaatatgataaagtcaaaacaataataaaagaattacgacaagaaggttttttagtttcaatggacgattttggcagtggttattcatccctcaatatgctcaaagatattaatgtcgatgttttaaaaattgatatgaattttttaaacatgaatgagcaaagtagtgataaaggaattggtattttagaagcaatcatcaatatggctaaattaatggggcttagagtcattgctgaaggaatcgagtctagccagcaagttgaacttcttttagatttgggctgcctatatgctcaaggctattacttttacaaaccaatgactagcaaacaatttgaagcaattattaaaaatgacgataaggttgactatcgtggtatccaggcaaagcaaatcaattatattagtattaagaccttagttgatcatcatgtattgagcgatgccatgttaaataatattttaggtggtattgcattttttgaatttgatggtcataatatagaacttttaaacgttaatcaaaattattgtaaaattgttgatgaaagtggcgttgatgttgaagaaaagcgactaaaaatattagaaaatatttatgagcctgatcaaactatttttctcgacctatttgaacaagctacagtccacctaatcaatggtacgaagggacaaatccgttacttaactgctaagggcacttataagtggttaaatatttatttatttttgttaaaaaaactagatcactcgaatttgtattatgcgcaggtttctgatattactgaacaaaagaaaaaagaaaaacagttagaatcttctcaaaaagctctagctgctgccgttcatatttcagaaaacgatgattcttttatgaatttagctgaagaaaataaagccttagcttcctccattttttctcaaatgtcacccggaggcatgattggcggttattgtgaagatggctttccacttttcttcgctaatgatgccttagtcaaattactcggttatgaaacttatgaagaattcgcaatagctatcaaggagcaggttattaatacaattcatcctgatgatcgtgaacaagtagctaaagatattggttccaattactattctggattagaatacactacaacttatcgaatgcctaaaaaagatggtacttggttctggacgcttgataaagggaaagttattgaaacagaagatggacgattagcgattgtcagtgcctgtattgatatttcagaaaccattgctgctcaacaaaaactagctaaacacaatgaaacactacaaaaagtaaatcaggagctttattatttgaataataaattacctggcggttatcatcgttgtgccgatacacctgattatgattttattcatattagtaatcgcttcttagaatttttcaactatacccggcaagagataaaagaactttttaatgataaatttataaatatgattcatcctgatgatcgtgctaaagcagttcgtacaactgaaaatttatctcagcaagatgaatcgttcgacttagaatatcggatgcttgctaaagatggatatatttgggtaattgaccagacatctgtattagaatataatggcacaagattttttcaaggggttgttactaacgttactaaaaatattgaattacgtaatcaaatgcagctattagagaaatactctcctgttgatattgttttaataacttgtagaaaaaataatgtaaaacatacaatcattactaatggtctaatttctaaatatggttataataaagaacaatatcagcgatatcttgataataaagaatttgaatataactttaatcgtgatgcctttaagatatttgaacaaaatattattaaagccttcaaacaacaaacagactattacgaaattctatcaattaatattaattcaaaaacagtttggtttaaaactagttttgagtttgttaaagctgatgcagaagaaatccaatacctttatatctctagcgatattaccgcatttaaagaaaaagagtatcattagctaattattaataaaataaagtagacattaaaataaaccatatagatttatttcaacgtctactttttatttaatttgccatttgctacttaaatcattatacttatctaaacaattctttcctcttaaaacaatactgtcacgataaataacctcatcaccattttcgtaataacctataacagtatgctttccatcaatataatcagttgtaaaaataaaatttgactgatgattttcatcatatcctgccacaatcgtcgctattgatgcgccaggtctaccacttttaggatctgttaaatgcaacaacgttgttaaaactctctccaaacatttgtttgtatcaatatcaagccaattctttaaatctatcggaatatataaataatcatttacttctttaatttgagtttcatcaatattatttgcttttgagcttcgaaaattaaataactgaattatattcctctttgattttgttttaaaaacaaacatcatatttcttagaccatctatatccataattgttctccttctaataagttatatatttattatataacttattagaaaataaaaaagcctgatcataatgatcaccggctttctattatccaattgaagcaactattgtagtaactaaattatcaatatcatccacttgctcagttttcaaagttgatttaattgtgattggttcgttgatgatttccatatccttcatcgtctctaatttagtacgcatgtgttttgcgcataatgctccccatgttccattttctaataacgctacacttcttttctttaatgataaagcaatcatatcactaaggaagttttccattggtggaaaaattccactattatatgttggcgctgctaaaatcaaatgactataatggaacacttcactaattaaattagaaacatgcactttagatacgtcatacattctaacattttttaccccggcttgcttcaattttgaagcaattatttccattacattttcagtattaccatagatcgaaccataagctaaaacaacacctttttcttctggttcatatttagaccaacaatcatatttgctaactatgtaatcaatattattacgccatacaggtccatgaagcggacaaattgtggcaatttctaaactactagctttttttaataacatttgaacttgtggtccatattttccaacgatattagcataatatctcctagcatcatcaagccattcatgttcaaaatcaacttcatcattaaataaagctccgtctaatgctccaaatgttccaaaagcatcagcactatataatgttttatcataactatcgtatgtcaccattacttctggccaatgtacgagtggtgccatcacaaaagtaaaagtgtgttttcctgtagttaaagtatcattctctttaactactaacttattgatctcaatcccaaaaaattgatcaatcattgtaaatgttttagcatttcctacaatcacgacttcaggataacgatttatcacttcttttaaacatgcacaatgatcaggctccatatgattaataacaatataatccaatgttcttccttgcaatgctgtttcaagattatcaaaaaataagtgtccaatcgaccaatcaaccgtatctaataaaatggtcttttcatctaacacaacataagcattatatgaaattccccttggaattggaaaaatattttcaaataaacttaagcgacgatcattcccgccaatccaataaacattctcatttacttctctaatacaattcatcatcacagcctcctaaatcacttttagtataaacctaatattctaattttactaatatgatgcttatattatttccaaaccctaaactattatccctcaaagattagtttagcagctccatattagctaatatctcatttattttttcttcaatttcttcttcacttttaccatctaactgctccaacaattcttgaataaaaggatcattaaatgcctcatcagcagtttcaaggccaaaagcatccattatcgccccttcaatttctagcgttatctcatcttcaaaataatcaatatcatattgactaataaaattcaagactaagaaaagaacatttaaattatttactacgattcgttgtggtttaccataacgattagcatattcaagcaatccatcaattaaagcttcaccaataatttgtaaactaggaaaatcaacttttttaattaaataatcgctttctccggcaattacggcataaacatttaactcattggttttatctgtattagtcattggtaaacagacaacatcaacacataaacgttctgtattttcacgcttagtttcaagctcatgttcacctaaatagccaaaatcatagcgatttaagtcaatttgtggttcatgaacaaaaatagcactctccttaaatttaccatcttcaacatatatttcaataatttcatcagactcactacgattttgatcttctttaatcccatttgcaaattcttttaataattctaaaattacccttgcttcctcaacttctaataagcatggaatatatcccgcttcattacgaaaagcagccaaatagttatcctcatctaatgccacatcaaaatcaagttcctgttcagataataaaatagtccagcagttgcaaaatgcattatttattccttcattagcaagattataaaaaccctctaaaagatcattataagtttcaaataattcaatcacataaccttctaatgtttttaaaataacccaatatgtagtttggttagatactagtttaatcacttgattatcagtaaactcacgtttcttcactaattcttttaactgctctaaaatttcaataaactcattttttaacgggctattatttaatatttcatcaacccctaacaatgataaacaactattaatatcttctagatcaaaattaatatccagatcatctcgacttaatataatttcttgataacgttcaattcccccacaatcctctatcaaattattaccacaaaattcaactacaacaggatagtgctcaacgccctctaactcttgttcaaccgtaattaaaagttgccaatcatcaccaaagtcataatggtagtaaattaccatttctttttttaaataatccgcaatccgttcaagattatcaactatctcaacgtcatcatttatctgattttcaatatctgtttcaccaccaggaatccagatccctaattccttgatcctaaattcatatagatgataatcttcaaaaccaaataaagtttggattaactgatgcagatcttcaaaactaattattgcaggtattttaatacgccgccatataggatccgcacacccctccacacctatcctcaattgatatccattcatcttttatctcctcagttctatataaactattataacaaattatattattgaagtaacgcctttatattgagaagataaaagggatttataaataattatcacgctcgactattttcaacaatcaatgttaaatgttttgtgaaataacgattataaatcacaataatttggccaataaatccagcagataatattgttcctatcccaattccaataattttccccgccaaacagtatgtagtaataattgtgacaagcatcattccacaatcaaataataattttgtcttaccaaactctttgtcaatcacctggcttaatgctttgaccataccatcagcaggattaggaattaaatctaacgttacaccaacatatgctcctaaagcagtagctaaaatagcaatcgctaatagaactaatgcaacaggtaatgaagtaactgtaaaatttaataagttattataaaaatctaaaacatatcccataaaataagaaaatggaatttgtaataaaactttaaaatctaatttctgataaatcaataattgcactccaacaaaaataatatataaaatagttgttgccatccctaatgataaattggtcatttcactaattccaaatggaactgaattaattgccgcaacccctaaaccagtttttgtatttaaaacaattccaaatcctaaaatcaatattcctaaaaaatataatcctaacctttttgccataaacaccctccttatttttctttattttacaatattacttgatattatcagttctttttcaacaaaagaaaaaatatccttccaaaagaagaatacttcatcaatcaatttttaaattgacaattccagtttttgaatatcgaaaaactaaatatagccattttgctttaatcaactcttgttttctgttcaatagatcactaataatagtattatacttttctaaaactgccgcagcctctttccagacttttccctcgattaaatcgtagttatcaattacttgagcaacgatcattgagtctatttctcctgcttgtgccatttgatttaaaatttcacaagtcttttctttactaaaagaagttttataactgcgctttccacatagtgcacttacaatatcacttattgctacaatccgctgctcttgagtcaactggttttcccataaactatgcggataacctgaaccattcagtttttcatgatgccgacacgcaatttctaaaatttcttgatctattttttcttctaataattctcttgttttaagaacatgactacgcattattatcatttgctcttgagtcagttgacccggatattctaatatttcaattggaattccaattttaccaagatcgtgcatcattgcaccataatagatcttttttgtctgttcagaacttaagcttaataatcttgctaactccaaagatatcgtgcatgtggtaatagtatgtgtaactgtaaaataactacgaaaatcaattagagaaactaacatatttaaataactatccaactattctaatgaaagcgaaatatttaaactagttactttttgccattttgaaaatggattagttgtaaattgatagacttgatcaacctgccaataaagagtagtaaccaaattttctacaaatctagttcctgactccttatctaagtaatctttaagcatgctataatcatttgaagtttgtaaaaatacatcaattcgatcacacaaattaataatctgagagatatttttaatttcgtcatcaatataaatcattttttgataatcaagatgatgataaagaatagcaggtgccaatttatctagtggtgaaaagttctttatgaacaaataaccataaatagcatgttgccatatattttttgtttcaaaaataaacatttgatcaattttttctgtcttatatgctccaatattatgtaacattgctaacataaaaacatcttgcaagtacttttgttcatgactattttgagcctcaagcatacgatatgtcatattagctactcgtaaaccatgatcaatcaatcgcgaatcaacataattcaaacaattacttataatttcaataaaaccttcattatttactcctgcaatattattcaacttatttttccatcgcatccactgacactttttcctctcgataaaatatcaatacaaaaacaattgccagtaaacctgcgattatcttactaatcatatagattatgacgccattaccatcgactacactagaaatgaatcctagctgtccccctaaaacataagctccacttacactaaaagcggcattcatcatcttccctttacgatccatttgtgaaaacaatggaatcattgcaatgcttgtcccaaggcttaatagtagtcccatcacactagcactattgacacccaacttttgaccaatcatgaaaatcattcgtgaaaaacgtttaataatcaaatcgcttaaaatcattgatccgcacacaacaatgcacatccgtaaaacaattaccattgcatcactaattaaagcaattgtagtaaaaggcaatgtatcaaaaaacagctgtaaaacaaccattccaaacaacaagatactaataattctaatcaaataaccaaataatgttaaaacaaaaatggttttatcataagaaacatatagagcaattaccaagataacacaaagtataattattggtaataagttaattaataaattaggaatttgtaaataccaggcaactgccactagaattattggtaaacttaaaatcccataaactaatccactaataaatggatttaaatcttccttttttaaagatgctaaaaaaattggtaattgaaaactaattgtttgtcctaatgttgcagtcaaaataacccctgaaaaaatcaaaaaagtactattaccaagtcccgaaacaattgaaaacccacccatatcaggtgcaagaatactcccaacaacaattgatggatctaatgatgaatcggcacttattttagtaatcacatctacattattttgaatcaatgtaattgcgatacaataaaacccaatcatactcatggcaattccacccatcgaatccatccctttatcaaaagcagctactagtcccaacttattattcaagatcttgtcaatcaagccaatcaagcacaaaataagcattattaatataaaaaaattcattatcgtacctcaatttccatattcttccaatattttaccaaacaaacctcaaacaaaaaagcctattcggcttttatttaaaatattcagtaatattatccttatcatcaaaataattgatcttcattgcatctttagcacgtttaagtgttgcattcgctttttcattagctttaacacaaccatcttctaacactttcataacagcagcaatatcagcttgtaaaacagctcttctttctctaattggatttaatgtttcttctaaaacattaaataaaaatttttttattttaacatcacctaaaccaccacgacgataatgctcttttaattcatcaagatttttataatcaggtaaatatttttcaaaatattcatctttgcaaaaacaatccaaataagtaaacactgtatttccctcaacggttcccggatcttcaacttttaaatgatttggatctgtatacatactcattacctttttccgaacatcttcactagtatccgcaagataaatacaatttccaattgactttgacatttttgctttgccatctgttcccggcaatctttgacaaacttcattttcagccaacataatttttggatctaccaaaacatcaccataaatccgattaaaactgtgaacaatttctttagtctgctcaattaacggcatttgatcttcaccaacaggaacacaagtggcatcaaaagctgtgatatcggcagcttgagaaaccggataatttaaaaaaccaactggaatacttgtttcgaatccacgctgttttatttcctccttgatcgttggattacgttgtaatcttgaaactgtaactaaattcatataataagccgtaaactcaaataatgctggtacttgagattgaataaacattgtggttttttcaggatctaaaccaactgataaataatctaaagcaacctctaaaatatttcgtcggactttttcagggttatcagcattatctgttaaagcctgagaatcagcaatcataataaaaatttcatcaaattctcctgagttttgtaattccactcgtcgtcttagggaaccaacataatgtcctaaatgtaatcttcctgttggacgatcgcctgttaaaataatatttttcatataaatctccttctttgattaaataaaaaaggcttttatcctcaaggataaaaaccattatgccaccttgtaagacaccatcatgtctgtttttcttaacgcgaaaagcacggcgccactactccagttaagtttcattttgcttctaaccaggcccattcatcagtatctttatcttggctctcaccagccaccaagtctcttaaataaagattagctgtttactcttcctagattatcgaatttactatacttaaaatcataaaacggatataaaatgatgtcaatagtttattaataatcttcaattatttttatttttttctacaatctatcttgattccaatgcctcttctgtatattcaacaaaatactcttgataataaataattctaattaaatctaagattgccataatttgataattaaaactaattccatcaaacttacccggtaaactaaagaaatacttaatacaacttaagttttcattctcaagtagttgattttgggtaatcaataatgtcttactcttgcttaagtgccctaaagattttttcgctaagaaatctcttaatgaacgcccagtagatgaaaagaatactacaaaatcattttcatcaaatttaatatttggatcataagcatgatattgaaccacatttttacctaatgtaattaaatcagtctgaaattcaacagcaatactagttggaaacagtcctccaacaataattactcgatcagcatcatatatatcatggcatatagaaacaatattatccataaaaatatcataatcatttacttcaatcaatctgaataaatcacgatagctcatacttaataatcttgctcgaatttggtcattacgtaaaatatcatcagctaccagcttacgatgaaagtcctcatagttatcaaaaccaagataatttaaaaatcctaggatcgttcgtggatcaagatcactttctttacaaacttgtgcaaatgtatattcaatcattcgatgataatttgcaattacaaaagtacaaaattgatagtaaccgtcataaaataaagtgccatttaaatacttaataattcttgataacaatacatcacccataacacaattctcccttcaagcaaatatttacttttctacacttatactataacaatctttgttgtcaggcgatattaaaaaagaaacattgaaaatattttttcaatgtttctttttaatttaaaacaatcctgttataatcgttacattcattcgtcatggtttgtcattttcaaatatgtttctgttttatatttaacatttttatcatagtctaatttaaaataacatgtataaatgcaatctaacaaataaagtaatgataaccttgttgaaaatgaagaaatcttattataatgattttcatatggacttaagtaaagattataatcacaaagactaactaatgactttagcgtcgttgaagaaattaatatgattggagtattgttctttttcaacaatttaacaattttgtcaacaatcattccccgtccttcaaagctaacaacaattgcaatatgttccttgtcacttgaggcagctgctaaaagctgttgatattcttcaaccggaacattaacaaaacgaccgatttctgacatttgaaacttaaagttttcaacaaagtaaagattaccagctgaagtgtacatatcgatgaactgagcattttttagagctgaagcaatcagtcgtaattgatccaagtcaattagattattcgaggcaatcaaagtctgctcgtataattctttcattttcattgtaatctgatactgcgtctcattttgtgaaaatggatagttataatcaattgttttcttttctttcaaataatctcttattgatgttgataccattactttaagctgtgctaaaccattaagctctagttttttacacagacgataaatcgttggtattgaaataaagcaagcagcactaatttcatcagcactcatattaataaagcgttctggattatttttcatataatcaactaaagtctgttcattggtagttaaatctgttaaattatccaatcgactaaatatattcattttctcagcccccttatcctcgtatcattataataacactttgacacataaatttcctaaataaacaaataataaacataagctaacactcagtaaaatatatcctcccgccatcaaaaacttaccatcactaagcagattcatactttctagtgaaaaagttgaaaatgttgtaaagccgccacataccccagttttcaaaaataaaatccagcgtgattcaagattatacttacttgctaacgctacaactaatccaattacaaatgccccaatgatattgatcatcatagtcataaaaggaaaagtagtatctttaattataattaatcccattaaatatcttgatacagcaccaataaagccaccaattccaactgctaaacattccaacataattatctcctctatataatcttattttatgattattcaaaaatttaagcaagtaaaaaagggaagtttacttccctgccaaataagcttttgcttcatagcttcttaatatttgttttaaatcatcttcataattactaatcagcaaagttccttgaataaattctaaatctatttccacttcatctttactataattacaaataactataacctgttgttcgtttaatgttcttcgataagcataaacttggagatgttcttttaaaagctgctgatagtcaccatagatcaatacctcatattcttttcttaatcgcagtagatcacgataaaaataatataccgagttagggtcttttaaagcgttttcaactgtaatatttgtatatttttgacttggagcgagccacggctgaacaatactaaaacctccaaacctactgttatcccacggtattggcatccgagcattatcacgggaacgtttaccaaaataagcaatgatcgtttcttcatcataattctgtttaaaaacttcatacttatttaatgcatcaacatcgcgatactgtgtcattgattgataatatgcatttgtcattccaatctcttcaccttgataaatatatggtgttccttgcatccaaaacatgaataatgctagcattttcgcagatttttcaagataaaaaggggttgaatcatcaccatatttagaaactgcacgtgggcggtcatgattatcccaatataaagcattccatgctttaccattcaaacctgtttgccaccgttcaaaaactacttttaaatctgctaatttaggacgctgataagttaaatttggtcctttatctaacgacatatgttcaaactgaaaaatcatcttcaattcacgacgatcaaaccctgcatataatagagcatcttctacactgacatcagctgtttctcccactgtcatcgtatcatatttagctaaaacacgatcatgcatctcttgaagaaattcatgtactcgtggtccattagaaataatttcatacatatgcggatcattaataatggctttatccattttttcaaaatctttagatatttggttaataacatccatcctaaaaccatcgatacctttatctagccaccactccatcattttatatacttcatttctaactttttcattttcccaattcaaatcaggttgttcctttgtatataaatgtaaataatacatttctgtatcttcatcatattgccaggccgatccctcaaaaaccgattgctgaagattaggcggttgatcatttttcccctcacgccaaatataataatcacgatactcattatctttagatttacggctttcaacaaaccagcgatgcttaaatgaagtatgatttacaactagatccataataatttttaaacctttttgatgtgcttgtttcaataattcttcaaaatcagccattgttccaaaatcagccataatatcctgataatcactaatatcataaccattatcataatttggtgattgatatactggacataaccaaataacatcaacccctaaatttttaatataatctaaacgactgataattccctgcaagtctccaatcccatcgttattactatcttgaaaactccgcggataaatctgataaacagcagcctcctgccaccaacttttttgcattatccttcacctcttttatatttaaacataacaaaaagtcaaaatcttggcccttttatactataataggcaaaattttaaccttttcgatattttgaaggaatatcgtgataatattctttaaatattttattaaatgctttcacatttttaaacccatgatttaatgcaatttcattaattgtgagactagtattcatcaaatcattataagcatgatttaaacgaattttattaatataagataataatgtaatccccgtcttttccttaaacattcttgataaataaacctcactaaaatgaaaatgattagctaaaatcgtcaaattcaattcatcatcataatgctgttcaatataagtgacgatttgtttaattatcggtagtttcttttttgtgattgccaacttataaacactacattcttccagcagctcatatatttgcatcattcgattatgtataactaaagtttcttgatcaagatgatcacctaaataaataattagctgttctaattgctcttgatcctttattaaagataaatcaaattcacattgtaccagtttaaattcatcaaataactcagttgataaaagtaatgttattattttcgtttgatcctctaaaaatcttaatctatgaatactattactattaatcaatactaactgcttagtattaacaaacttcttttccccattcactgatagttcaaaagaaccttgattacaataaattaactctatttcgtcatgccaatgcggcttcattactttactgcgattaaactgatgattccaaatcttaataggatatttaaagctagtttcaacaacttcatataaatgctgcattatcatgcctcacaaaaaggattgcttagcaatcctcatcttctttcccatcccaacaatatgtacataatttacatttatctaaaccgattgattcgatcatgtcatctaaacgatgataacgcaatgatgtaaatttagagcggcgacgaatttcctcacacatatttttatatctttcactatctgggtcagcgtattcttttaaaatctcatcactaacattatcaccttctagtttttggataacacgacgagtcactaaatctaattctgaactagagcgtgaaaaatttaaatatttacacccgaacatgattgggggacaggcaggacgaacatgaacttctttagccccactttcatataaaaattctgttgtttcacctaattgtgttccccgaacaattgaatcatcaatcaataataaacttttatttttaattaattctttaaccggaattaatttcatcttagcaatcatatttctttgactttgactagatggcataaatgaccgtggccaagtcggtgtatatttgataaatggacgagcaaagggaatacctgaaacatttgaataacctactgcatgggcaattcctgaatccggtaccccagcaacgctatctggctgtacatcatcacgttttgctaataaattaccacaacgattacgcatacactcaacattgattccttcataagttgatgttggatatccataataaacccataagaatgaacaaattttcattttatctccaggaccttgtttaacttcaattttacttggtgtcatgaaaacaatttcccctggtccaagatcacgataatgatgatatcctaaatttaaaaatgcactactttcaaatgtcgcacaatatccttctggtttttccccaataatcactggtgttcttcctaatttatcacgtgaagcataaattccttcagatgttaatatcataatactcattgagcctttaacaacgtcttgaacatatttaattccttctacgatactatccttttgactaatcaatgccgctactaattctgtaggattgacttcacccgaactcatttccaagaaatgagttgcccctttagcaaaacaatcatcttttaactcttccaagttattaattctacctactgttgtaatggcaaaagatcctacgtgggatctaaccaacaacggttgtgcttcattatcagaaatacaaccaattcctaagtttccttcaaattcttctatatctttttcaaatttagttcgaaacggcgagttttgaatgttatgaatcgatctttgaaaaccattatttccatgaactgccattcctcctcgtcttgttcctaaatgggaatgataatcaatcccaaaaaacaaatctaaaacgcaactttcttttgatgcaacaccaaaaaatccactcatttatatctatcctccaaactttatacacccattgtatcttatttgtaacaaatttcctatatttaatcttattttcgctaaaatattgcccaggaaataaagaaaaacctgttataataacaggtaaaatatcaaaacatttgcttatcaatactattatctacaaattctaataaagaaataattacttcttttaactcatttgacttctttaaagtttcttggtcaaaatgtctttccaaataatcatgactaccataatagacttttaaactaccaatagaattagtttctagatcatttaacccttcaaaatcagctatttctagattaccaaaaagctgataaacaagatttcttgctacttcatcattagtttctttgattttatcatcttcttttaaatactctgtcctcattttataatgagatgcttctttcaacaacgttacattcacgactattctatctgaggtttctaagcacaaagaaattagcttatgttctggcaactaaattcctccttcactaatactaaattatatgaaaattatatcttattataccccattagttagataataatcataaaaaaactaggtataagagtatacctagtatcaaatatatttctatcctatcaattcaatatttttttaatcttattttattagctgctgactgcctttataaatttcttgggttatcaagattatattctttagcaatttttttgaaattatataaaaggtagcgatgacgtactaaatcatccggcttactacgatacaatgttacaattccataaggatcctccattacaatttgatgattctccaatgtatcaaataaacttaatgcatttctttgatttaacacttcaaagcgacatatattattatctttagtaattatatctagatcaagataaaatctaaattctggcatcggccatgaaattattgatcttgaacacattgagatttttgtactcttaatttcaccgtaaggaatttcaatctcctcataattagtattattgaacctgacagcatccttatcgaaatttaaaacacgattacgtaatgcagacgcttcatcatattccaatccatcaaaaattgcataaacaatcaatcgtgcagtagtagattttttgggctcaaacgtctcaacttttacttgactggtagtattttcattcttcctatcttctgttttttcaccaacagaattttttatttccctctcttgaaattcttttttagattcctttttaagattattttgaggattaaacaattttaataaactatcctgtgttgttatcttaacaatctcattaaaaaaatcaacttgactgccattttgacaatcaatccgattaataatttgtccatcacgtaaataaagaaatttctttgcataactggcaatcatattatcatgagttactaagataattgaggttccttgttgattcagttctcttaagatttctagtacttcatgtgaatttttagaatccagattccctgttggttcatcacaaacaacaatttttggcttcgttactattgctctagcaatagcaacacgctgccgttctccaccagaacattcatttggctttttatatagagtatggctaatatttaagcgttcaccaatctcattaacgcgttccttaatttcttgtggagaaacttcatttaaaatcaaaggtgtagcaatattgtcaaaaacagataatgatggaactaaattgtgattttgaaaaatgaatcccaaatatcgattacgatagtcacttagttcagcatcattcatctcaccgacaaaacgattaaatattttaactgctccactacttacttcatctaatgttgataaacaatttaataatgttgattttccggaaccacttggccccataacactaataaaatccccttcctctaagatgaaatcgacatttcgcaatgcataaaaattagcgccacgttttaataaaatatcctgatcatatattttactaatattattcgccgtgattaagatatctgacatcatcgtacacctccttgattaatttacgataactgacgatcatatatattgacataaatgtatataaaataatataaattgcaatcattgtgataaaagtattgtaagtaatcatattaactaaataactttgatataataaggatccatacataacaattgggaatatcacaattaaaataataaacagcatcatctcttggtaatgaatcttaaaaatactttttttgttgtaacctaaagcccgcattgttgcaattactgaagctcgggttggcaaatagatcataaagcgaataataaaacaaaggaacattgacgccattaatgcaaaaaaactcatcatcattgcattttgcacgtcaatcgaaactgactgcaagaataagaaactaataattattggtacaacaacagctgaaatattgatcattgctgtcattacgtcagtaagatcttttagattactaagtgatatgatccagttctttgattttagtaagactttattatgcaataagtcaaataataaaggaaatgtattatcaatgatgaggacctcacctaataatgaaaaagcaaaataagtaggtaaattattattttcaattgatcttaacattggcgtaaaacctatatatattagtaatattcctagtattgttgataatatttttccttttggaagcatatcaatagtttttggcttttccccctttaaagctaaaccacttgacattaatttaaatggattaaaattagttgtttttcgtggcacatgattcatatagccagcaatatcagttttgatcctcataaattttcccatatcaataacgaccacatagatcatttttgttaagaataaagcgccataaataattaaaatattcgttaggtcaactgtaatcacagcatcataaatagcactatacatataaacccaaccccagccaattaaaaatccaagcgcataggaaattagaaatagcaatccaaattgaattaaaatatagcgaattatctgcttcatatttcgaccacaaagcagtaataatgaaaactcctcgtttttattattaataatgtaattattcacaaacaaggtcaatgcaaatgcaatcatgattacaattcccgtgactaactgcagaatatagccatttgcaaaatccacttcaatattactagttgaatacatcacaaccgaaatgaattcgaatgatgataacagtgataaaactgctaatatccctaaatacagttttttctgcccggaaataatttttttaataaatgtaatcatttccaaatcctcccttcactaaattctttatctactttaagtatacgcttacattttttaaattacaaatattattataattatttttaagtgaataactattatttatattaatcatatgtaaaaaaagtaattaaattcatcttttaataaaacagcccctacaaatgatacatatcattcatatgggctaactatttttatcaatcaatttttcatattcatttataggcattggtttatagtacacatatccctgaaccaaatcacatcctacttcacgcaaaaattctacctgcgaaacttgttctacaccttcagcaaccgttttaattcctaaattattgaccatcttaataatatctttaataattaatttaactttatccggattatctgaatcttcaaaaaaagcactatccaactttaaaacatctattggtagatctttcaataaatttaatgaagaatacgcttttccaaaatcatccatagaacaaataaaaccataatttcttaaatcattaataattttaattagtaaatctgttctttcaaaagcaacactttcagtgaattctatctcaatcattcgatcgggaataccaaattcttgttttatttggtaatactcattcacaaatttagaattgtaaaactgcactttagatacattaaccgaaacaggataacatggtaactcttcatcaattcgttttctaatccagctacaaacttcacgatatacatatttatctatctccttaatatgcatatttttttcaaaaatagggatgaacagatcgggataaatcaatctatcttcactcttccagcgaactaatgcttctgcacatgcgattttaccagttttaatattgactttaggttgcaaatatacaagaaattcttgattgtctaaagctgtttgcatcctattttcaatcattttatccatatgcaatttatttctaattgcttcagtataaaaagcatagtgttcttcagaagttctttttatagtatcttgagcaaaaatagcacgatcaatgtactcatcgatagtaagtttttcaataacatcttcataacagcaaataccacaacaaagcctgatttgataaccattctttgctttctttacataatcaatcaaaatttgatcaatttctatttgtttttgttttaacatttctttactctcataatgacgcaatataataaaactatcagcattatttcgagcaaaagtttcatttttatcaatactatttgctaatacagctgcatacttttttaatattttatcaccaaattgatatccaaagacatcattaatatacttaaaatgctctatatcaatatacaaaaaagcaaattgaccttttgttttcttaataatatttcttgcctctaaaacaaatttaagtcgattatttaccccggtcaagttatcacggtaagctacgatactcaaagtattatttttgcgttgcaatgttatcatgcttcgtaaataaaaaataattattatagaccatgtcactaatgaaattcctgataaaatcatcaacatcattaatagataattactttgtgtcgtagtataatagtcaactgcaaagacagtatcgtttgctatctcaaataaatcttcactatcactaagcagtttctcatgaccatttccttcgcgtactagaactatatccatttggattgcttcccaaatattttttaatttatttaaatctgtccggtaatcttcatcatcaagattaattagactatatttaccaactcccgtatctaactctgtaagaatctcatcaatataatcttttaattcgtcatttggctgatcagttaattctaatttgaccaaacgctggctcgcaccacgaacaatcccaacataattaatcaatgtcccataatcacgaattttatataaagtgtgaactgatattgagcataatagtattaatgttaataaaaaagcgggtaaccccaatctctttagtctcatctctatcacaccctatcaccttaatgatatgctaatcattaggataaaacaagcaaatgccctcatttttacattttttgtaaaacgcttacatttttatcaagtgatttacacaagaaaagatttaaatatcaaatttttacttttataatacaattaacatatatgtttaaaacaactagttgcaaaatatgattgaatggagaatatcatgaaaacaagaaacttaatcgcaacatcatcattagcacttacaatgatgctaggaatagttgccacccctttatcagcacaacaaacatacacacccggtgtgacggtagagaaaaatactaatccagaatgggaagcagactatacagcaaccttcatttacaaagataaagatgcgcgtgatgcaacaaatgttagcgtaagcggtggtttccaattttataaacccgaagaagtacagtcatttgcaaatactggtgacggggctaatatcccatgttataatgcttatcaatatcaagatggaatgttcgctggagggtacaatcttaatggtgatgccgcaaattattcaatgactgaaattgaagatgaaatctttgaggtaacgatccctttacctgcaaatgaatacttttatgctttcaatattgaatattcagatggcagtagtgaaactaatgtcaaagatcctgctaatcccgcacttgctaatgatggttcagatgctggatgtagcctattttatgtaggtaatggtgagactaaaggacaagaatatatcaaccctcgtaccgatggtaaaacaggtacttactcatttgtcaattatttagctgaagatggaactactcaacctttaggaatctatctaccgaatggttatgatgctaataaaacatataaaacaatctatgtttctcacggtggcgggggtaacgaggtagaatggatgactattggtgcagttccaaatatcatggataatttaattgctgatagtttaactaaagaagcaattgttgttacaatggataatacatacttcaattgggactatgatcgtattattaataacctatttaataatattttgccttatatcgaaacacattacaatgtatcaaaagaagtaaacgatcgggcattttgtggattatcaatgggatctatgacaactacgactttataccagacccatcctgatcaatttggatattttggctgcttttcaggagctaatgttccagttgatgtaagtaaagttgcacatcttgatcaaccaaacttatatattactgctggctgcatcgatatggccttaatgaatgatagttataatactgcgagcgatcgtactacaactggattcgtagataagctaaatacattaaatctaaccaattacaaattagaaattttaaatggtgctcatgactggtacgtttggcgtgaatcgttcactaactttgtaaaagatcacttgtggactaaagatgttaagatagaaacgcctagtgaaactcctgttattaaaccagaaacacctgcttcatcaacaaatactactactgcacctaaaacaggtgacgatttaaatcttgctgttgctggattatttatcatcatctcagtgacaactggtgtagttataaaaaaacattactaaatacaataaaaatcgtaagttcatgatatctcttaacaaagaagatatcaaacttacgatttttttattactcgtactttataaattaattcagaaataatttgacttaaataaaataacgaataatagccatcattaattgatttaggaatgccatattgataaatataatcaaatattttctgctcagctaaatcatcttgagcaaaaacaacaagttttaaattcttctgactagctttctctactactcgtttttgaatttcactataaaaatcattggacacatttaacaaaaccaaagtatctccatctttaaaaaaatcactatgaatatcttgaaattcctgtaaatcaaataaatatgcaggaacttcattcgccaccaaatctaactgcacagtataaaagtcaatcatttcatgagtatcaccaataaatgtaacactacggctattaagcaataatttggttatagcaacaagtttttccatgtccaaattaagttttgtctgacgaagattgctgatagcttcaacatataaagaatcagctaaattatccaatgatgtacgcataaactgctgcatattagataccgttcttaccatatttaaattacgaataaaatagtctaaaccatctttaaaatcctggaaagaactgtatcctatcttttgaacaaagcgactaaccgatgcaatagaaatatttgcttcttgagcaatctgctctaatgaaacggttttaatatcaccaatatgttcaatgataattctagcaatattgtattcattagtattagaaagattttcattacaatatctaaaaaaattaaatcccaactgctcgtgtctcttcataaattccctccattttttatattatatcaattaaatatcttaattaaaaggaattctctttaaatgtctagacacataaaaataaccgggaccggttatttttataaagacatacttttacggtcaaaaattattccacctaccccataacaaacaatcattactacaagtaatcctcctaacattaaataaccttcattattaccgttaatcaatttttgaggatcaaataaagttaataatgttgcaaatttaagtccttccatacttccttgcatattcgaaagcatttgaatcataataaaaactatcgggattcccgctccaaataacgatgctaagcggtactcattaaaaatacaagaacacatataacaaattcctgttaatgttaactgtaaaatgaaaactcctaaatttaaaaccaaataagctccaatatccaaatcaccaggaaacatcaaagcactacatccaagccctaaacctgtacaaaaagcaattaaaacaaataagtttgttatgataaccagcatttgtgtaaaccacacagatctacgttcaacgccactacataataaataactcatcacaccattatcaacttttcgaacaactaaacgtaatgctagtaaaattccaaaaatcaaaggaaaaacaatcatgattaaaccatataaataagtagagagaaaatcaatcagtgttgtcggggtaccactcattcctaccattgccattatttcaggcatacttttagcaaatgtttctagcgctgttcctagcttaggatcatacattgctaacatgatcgttgtatacattgtcaaaatcaaacaaaaaataactagtatcttataattagatttccattctaatttaaataacgctttattgaacatgttgatttcctccataaaattgcataaaaatttcttctaaactttggtgtgcaatatcaaaattcattaattcgtagttatttaaacaactgatcaattcattaatttcatgctttattacaacctcaacaacattatcatcagcatttctaattgtaaaagattctttttgaaatttgtaagcatcttgatgatttttaaatgttattatatatatcttttgtttcgatttctttaatgtgtcaatatcctcaatactcaccattcgtccttgacgaataattcctacccgatcacatgttttctctacttcttcaaacatatgtgaggacatcaaaatagtcttaccacgcttcttttcttcaataattaaattaataaactcactttgcattaaaggatcaagtccactagttggttcatctaaaataaaaacagctggatcatgcataaaagctactaccaaacctatcttttgtttcatcccttttgacatctttttgatttttacatgaggatcaagatcaaagcgttcaattatttcttcagcacgccccaaatccttcattccccgatactcagccataaatttaataaactgaattccagtaacctcctccattaaattaatttctcctggaatataaccaatcttcttttgaatctctgcaattttcttactacaatccatcccttcaattaaacaggttccttctttaggaataataaaccctaacaaatgtctaattgttgtagtttttccagcaccattaggtcctaaaaagccaaaaacttcacctttttcgattttaaaagagacatcaaatattcctttatcattaccataatcttttgttaaaccattaatctcaacaacactcatataaattcctcccgatagaaattctcttttataatatccaaatatctaaaatactcatcttgaatctctttcatattaacattttctaaatcctgatatctatccatatatccttgcgacatccaataaattatgttccaaacttcttcaggatcaactcctgctttaaacttactaatatcagcacgtttaattaaattatatgatgctattacctctgcatataattgttcataactatttcctactatttccttacgattttggtaatagcgcagtgaaaagccataaatatatggatatttagacatcatttccattttgcctaacactgctaatttaattgcatcaaaaaaatctttaccatctataatattcattttttcaaataacttcatcactagtctagcgctatattgtgctaagtactgatacaactctagtttattgtgaaaataataaaacaatagtccctttgatattcccgctttggctgcaatatcatcggttaatgcatgtttataatcatttttactaaatacttctaaccctgcattaataatggccagtcttttttcttcgtttaattcaaagaatttttggttcattttatcacccctttgactgacttgattaattaaattatagcaaattgactcgtttcaacaacccctcgtatcaatctttatgcaatcttaatagtccaaaaaataaagaccaaaatgaaatattttgatcttttcatcatcctatcttactaaactcttagctaaccaaatatctggttttcctaaaccattggcatcaggaatcaccccaactatttgacatcctatcttttgataaaactcatagggatgtcgttcaagattcctaatattttttatctttgaatatagatcatcaaataaattagtattagccaatgttgttttatcaaattcatcatcactgcctaaataaatggtacagcagccacaattcttaagctcattttctaatgctgtacaaagctttgtaccaataccttgaccttgccactttttagaaaccgccaaaggatgcaattcccaagcagtgattccatactggggaatagccccaaccaaccccatcaatatatcattttcaactgcccccagcattattctatttgttgataaacattttgttatttctagctcggcacaatctttatatgcatatggaaatgcttcaatcaataatgtagctgcctgctgacgataataggttaaattagatgttaacttaattatttccatattttcaccccttttacttatataataccatctattttactttaagctgcttaattcttatttttatattattaataatataaaaataggctgtaactaaatagaataaatttattctagaggggttatacctcttttttatttcaactgtttttggatattcataaatgtaatgtaaatatctttatttttaactattataaataattatttctcttttcgatactttctatgttggttttcaagaaatgtgatactagaataaaaactgtaccagttaaatgaaaaaaagcaatcagcccttcatgcctacaaagctcatatcactttcctttcttaatagaactgctagctatcatatagatttacctcaaaagtattctaacaaagagtccagtttttagctatttaaaatacttatttattaaatcatttatatacatatcaccccaatatcatatttcctgcaaaacaggcattaaagactcccccgctttgaaagatagtattctacttttggagaaatttaaggatattcttttcttataatgaaataatcagcctcgagttcttttaattgtgtacttaacattttgtgtgatatagtccctaatggacgttttaattcactatatcgcattaattcagttttccaaagctaaaataaaatattcatcttctatttgccacctataattgacattgtatattcaagatggttttgaattaactgctccatttgtttacatctatacttattttttcttccattttaaactctccttttagatagtatcttacctaaaagtgcatactgttatttttgttaaggtagtgctatattacacttaataaaaagaaaaaaggagtaatgatgatgagaaatttagataaatcaatttcaatcaacggattgacgttaaaaaacagattagtaatgcccccaatggcaacatcaagtgctgatgatggtgaagtaagtcaaagaattcttgattattatgataagaaaacaaaaggtggatatattggattagtcattactgaacacagttacattgatattcaaggaatggccaatcctaaacaaatgtcagtagcaaaggatagcgatataaaaggattaaagcaattggtaaatataattcataacaatggaagcaaggcgtttgctcaaataaatcatgccggttcaatggcaagaggaacaggattacctactgttagtgcaagtaatacaataccaataacaatgaaagaatccaatatcgaaataccagaagaattgagtaaagaacagattcaatatatagtaaaaagatttgctgatgcagccagacgcgtaaagttagcaggttttgatggggtagaaattcattctgcacatgcatatcttttaaatcaattctattcgccaataaccaatcatagaacagatgaatatacaggtacaacacttgaaggtcgattgagaattcataaggaagttattgaagcagttcgaagtgaagttggagaagacttcccaattgctttacgcttaggtgggtgtgattatatggctggcggctcaacaattaaagattccattaaagcctctcaaatgcttgaaagttatggtgtagatatccttgatataactggtggaataaatcgctatatgattccatggaataaagagccaggatatttttcagatatgacagagcatattatggaaaaagtttctattccagttattttgacaggtggaataactaatgccatggatgctgaaaaactactgcaattaaacaaagcagatttaattggtgttggtagagctattctaaaagatgatagttgggcaaaaaatgcaatggaacaaaaataatgcaaatactggtatctataatacaagtatttgttgaattacgatacaataaatccggagatgaatactatctccggaaatgcggcaatgacctctaaaaaatttaaaaagaaagtaagaaaagtttccaagaagttaggaaaaattgcctaaaacttatatttaaaaccatttttaagatggtaattcttctttaccatatcatatttattattaatttaaaatatattttgaaattataaaatttattacaattaaaaacagataaatttgtatgtacctaagaaaaacattattcattaatatattagaaaaattataaaggagaaaatacataccttttatatggggctttgaatataacggggaattgattacttgtttgaaatcacatgccataagatttataagataataaaaataatgtatttttaagtatatattttgatatttaatcttatttaaaatatagattacagtgtatatgaatagcgatacagctgataaacaattatttcttggattttgggattaatataataactatctttttcttttgtgagtaaggtagttattttttctataattatctcaaagagtaatgttaccactatcgctataattacgattttttgatattattttcactatataatttctaaataatcaaaaaagacaagaaataaataccatgctataataagtactgaaaaagtttaaattgtaatgtaagtttactattttaattttggaaaattattcagtatatttgggacataataatataatgggatatatttttatcaattgctatagtattttttaaaaggaggtaaaaatgaaattaatattaagtgataaatatctaaatcttgacgtatcagatcattctaatacaaaatttatagatctatcatcattaaatatagctaactgcactggatgctttggctgttggactaagacaccggggaaatgtgttatacgtgacgatgcaacaaaagtatatccgtacattgccaagagtgataatttaatttatatcagtaaaatattatatggtggttatgatacccctatgaagacaatgcttgaacgtgcaattccgattcaaaaggcatttattagaatactaaacggagaaacacatcatgttcaaagaagtgtagaattgaaaaatgctacaattattgcctatggagaaataggcactgaagaaaaagagatatttaaagctctggttgaaagaaatgctaaaaacatgaattttaaacactataaaatattatttacaaatgaacaaaacctagaaaaaactgtgaaaacggagatgataaaatggagcgaatagtgatattaaacggaagtccgcgagcacctaaatcaaattctaaatgttatgcagacattttttcaaaaaaatataataaagacattgaatattacaatataacaaagcaaaatcatgataaattatgttctaaaatgaatgatttctccgatatgttactggtttttccattatatgctgacgggattcctgctacacttttaaattttcttaaaagtcttgaaaacaacttaccagataaaaaaccagtaatttcagtaataataaattgtggatttttagaatatacacaaaatgatttagcagttaaaatgatagagctgttttgtaagaaaacaaattgtgagtttggatctgttttaaaaattggtagtggagaagcaatcctaaaaacccctttcaaaatatttgtaacaagaaaagtaaagaaattagcaaattcaatcctatcaaaaaactataaaacactccatataacaatgccgctcaccccaaaattatttattaaagcatcaacaaaatattggattgaatatggaaacagaaatggtatcacaaaagaacaaatggatacaatgagtatagaggatgacaataccttagtttaacagctatatcaaaaaggagctcttatgattttaaatgtagttagttttgatgaagctgcgctccatgttcttttatactagcaattattcatatattgtgtttttggatagaagtttagagtgtttatcgagagcccaactagattatattttacatcaagtccaaacagcccaactaatttcaatatcttctgttttagaattttagtcccattttctattagctaatctttatttgaaaatctcggagcatcatccttagcatctatttgaactttttgtacaaaataatcattattttcatctattaaatcaacaataaaattatatattccatcattatactcagtaatattctttttaatagctttatgcattaaagaaaagaactcaatatagcttatatttgcagtaagtattaatcctatacaatcctctatattgtttttttgtattatgtatgcctacaaaactcatattgctacaatccttttttaataaataatcagctgcatacattatattaccgccaactgtattctatcaaaatatgtatttatttactgcttttagaatattaaaacaaaaaatctctttagttttgtttatctaaagagaaattttatattataaaaatgttagcaaattttaaagatgcttttgcagcagatataacaatcataatattttttctttatctgtaagctagattaatataatatatggaatgataactactattttatactattcagttctatcttagtattccatatcgatgatagtcaaattagtctgaatctgatgatttcaaacaatgtcaaactgcaacatttttaaaattgtcatatgcattaaattatatatcatttattatcatacctaaagacattcttcgtcaaaatgataaatccttaattgattttacacaactttttgatatcatgcattaaataatccttctctattagaggcttgaatatatttaaaatattatcatctaatttattcaaaatctgaatatagataattggatgatagtcagcaaacataatagttgatggattattttttatgagtgacaaaattgcattgagatttccatctgaaatatcaatactatgttttgtgcaaatcaatcttaaatcttcaaaagacatttcttgtatcttgtgattaattgtttttatggtatcattcataaacatcatacctccttgcaatagcagtgcaacgaaaatgtctttatactttaattatactaatattcaataagttgtaaatttatataataagattttgtttgatattcaaaacaaaattatcaaaatagaattaagaaatatataaagaaaataattttaccaataccatcaaattaagatgacaacattttaattcaaaggaattatctaaaattaattgcattgaattgttattttttataaaaaaacatatgataaaaagcgcctgtaatgattgtgtagttttttagctattttagagtattacagttcttttttttgtaaattaaaataaatgataaaattttagcctttttactctgtcttttcctcattaatttactgttttttgacgcattttaaaagaattaccttatttttgaaaaaatttatatctctaattttacacctgctggtgttcttttaggaagctttccatagattgcttcatatttttcatcgatggtatatatgtttttaaatcattaccgttacgctgatatatataattcttataattccatcacttatcccaaattggatattatattcagatttaaatacatttgtatgcttatagtaatcgtattttatatgcataaatgttacatcaggatctattttgaaacagctgttacggtttcccggcatatctatatgaatagtatattcccatcaaacattttgtgataaaaacagattggttggattaaactattgcgtcacaggcaacgtgcataacagtgtatcgtttttccaacgtatgcgttactaaatgaagaatataaagataggacaaaaaatatatgtttaaatccagaatatatcacactgacaatttgtaagacgatattagaaaacaaacaaaagatgtatgcaccatataaaagatcaatcacaaaaaaagctacattaaaaaatatgaatatgtatgtcccaacataaagattttagaatacagcgctacaaataagttaggatataggaaatacaaattaaatccatagaattgcaaaaaacatcacaatttgagatatacaagagtaaaaagggcttaaggagaatcagcatcaaggactaatgatttttgcgtatcacattctaaaaataatagcaagataggggaacaacactgtatgtaatccaaaaacgctatttttctataagttagtcaatataaaaaaagcgatactcgttttggagtatcactttgtcaaaagtctgaaaaaagcgttcatcatagagtgctttttgcacaagacaaaaccacaacataattatttacccgttacagcctctttcttaatatttctatattctttaatgtatggatcccgataaaaagaataagctaactgtaaacacatacaacaccaaattaccggttcacaaataatcaccccaaaatatcctaacaatggaataaacagccaaacaaatactattttcccaataaattcaattatgcttgaaactaaaggaataatcttacgccccaatccctgtaaagaatttctaagattcaataagattcctaacatacaataaaatggagcatttagcattaaatataatgaaccattatcaattactactgcactacttgaccctgacaataattgaactagagttggggcaataaagaataatacaactgttgcaataacactccaccctactgcaattaaattagcataacggaccccttgtcgaattcgcaatccttgatttgcccctttattttgtgaaacaaaagtagatagggctagacccaatgttgctgcaggcatcatacaaaaactatttaatttacgagcagtaacatgtccagcaataattaaataaccaaatttgttgatggcggtttgcaaaataacagttcctgtagaaacaatcgacatcattaatcccatcgaaaaaccttgccctgccaattcttgatatagttccctgctaattttaaaatgctctttgtgaggaagcaaaataggacattttttataaatataataaaaacaaagaattgccgaaactccttgagcaataacagttgcaatagcagcaccttgaattcccatattaaattgagtaataaataataaatctaatcctacattcaagactgaagaaataagtaaaaaaacaagcggcattacactattgccaattgctcgcaataatccagcacacaaattataagcaaacattaccccaacaaaaatagtaatcataaaaatataatcatatgcctcattaattatatttgctggtgtatttaataattctaatagcggatataaacaaaactgtgaaaaaagcattaaaataatagttaacaagattcctattacgattgatcccgcaactgatttttttaacaagttctcatctttagcaccaaaacttcgtgctgtaacaatacttaatccatttcctacccctaaagcaaaaccaactaataattcataaatagcaccacatgctccaattgccgccaatgatgtatcccctaaaaagtttcctacgatcatcgtatccatagtattgtaaagttgttgaaaaacattagccacaaataatggaaacgcaaagatcaacaatgattttaaaattggatctttggttaaatcaactttcattttaaacataattttccctcttttatatattataactcatattattgtattcctattatcgccacttttcaacaatatcccttttcaaagaatgaaaaaaccaagttaacacttggtttataatgtcgcaataaaatcttttaatatttcgtaacaatttacaaatgatgcaacttccatacgttcatctggagtgtggatgtctgccatattaggacccatcgtaataatatctagcgctggcatcttccctttaaagattcccgtttctagtccaccatgagtagctacttcttttacttctgctccagtacgtttaaaataaaatgctttaaataaatcacgtaattttgaatgttggtcgtaattccaaccaggataataatttgctggagtaattgtgccaccaaaggcatctgcaataatatctaattcatcaaccatgttcatcacagcgcttttcattggtgaacgtagtaaataatctatttttaattgtttatctttaattgatactacacccatatttaatgaaaccgttgtcaaatcttcaatcactaatgaacgttcgacaaaaccactcttagctgccatcattaattttataatatcttttgattcttttatactcaacgtttgctgtgcaatatcattatttaatgataactcaactttaacaccaggatcactaatttcaaattcttcactaaaataatcttgatactcatctgccacttcctgaagtaacttaaaatcacttgtactagcaaaaacaattgcacattcacggggaatcgcattattttttaatccaccatttagatccactagctggatatctaaatttgccttgatcataccatacataactcgagcagccaatttattggcatttcctttaccgcgatgaatctcacctccagaatgtcctcctgacaatccttttattaataatgtataagttggattttcattactagtaaaatataattccttagtaatcattacatcacagcctcctgatgaagttgtgcaaatttctccttcattttcactatctagcccaatcattcttgtcgcctttaataaacttgcatcaaaacctaacgctccatcaagaccaacttcttcggcaactgtaaaaacacactctaaaggtggatttttaacattaggatcacttaagattgccaacatataagcaactccatagccatcatctgctcctaatgtcgtcccattagcactaacatagccatcttcaagatacaaatctaatggatcatgttcaaaatcatgattactatctttattcttttcattgaccatatccatatgtgcttccaacatcagtgtttcatgattttcatatccttgactagcttctttgtaaataacaatattatttaagtgatcccgatgatatctaaaacctttttctttcgcgaatgcttcaacaaagtcagcaatcttttcttcattataagagccatggggaattttacaaatttcctcaaaataataattaactaaaatctctgtgtctaaaacagccattatacctaacctccattttcactatttttattataacaaaatgtttaactaattaacaaatcaaattaaatgatgtataataatattattaaaggactttaataattattttaatttagattaacctgtcattaaatatcacaatcatgtatagcttttaggaggactagccaatgaaaagacaggcattaatactaagcagtatttatttgattataatgtgtctaggttatatttggtgctatccttttttcaaaatagaaacaattctttttgatttgatctttagaacagttttatggtcaatatctagctatggattatatattgtcttgctaatactaaaaaaattcagtttgttaaaaaacattgctattagcaaaccatttttaataacctgcctctcttacatttatttaattatatttcttgtagaaggattcattggtttagtaatggtttttgtttttaaaacatatgtttttgcttactcttttttctcaatattaactatcctccatgcaatcaaattatctcaagatcttctcaacaattattgtacttattaataatgcaggagtggcggaatggcagacgcgctagtttcaggttctagtgagattttctcgtgtgggttcaagtcccatttcctgtaccataattaatttaaagtttgtcgattgttatctacaaacttttttgtatttatttaatagcctaaagccccctgctaaactcacactaaagtgaaaaaacttttactctaggttactatctgatagaatataagaaaagcgaggtaagtaaatatgattagaacacgaagatcagccttcttaaaatagaaaaactaactatatataaatcaaggaattttaggaacatataaaacaatgaatccaagttatactattttcatttcgacgatgaaactttttctatcctatggagtgaatataattataaatttaaatatttctatccaaattacttaaataatcttaaaacttacggtgaaattaaaaaatatttcctaaacaagaatctgttaattcatttaacttttcctgtccaccctagttaacattcaatgagtttttttaacaattaatgataagccacattacttattaccaattttcgcaattggtaaatactacaaacaaaatgataaaactcttctatcactatcaattagagtacatcatcaattatgtggtgcttaccatgtttctcattttattaatgaattacaaattatgattaatgaacataaatttataaaggaataatgatatgattgaaattaataaaaaactagtacaaaacttaattaacgaacaatttcctcaatggaaagatttagtaattgaaccagtcgctaaaagcggacatgataatcgaacatttcatttaggatcaaagatgactgtccgtttgcctagtggtaaaggctatgcagcccaagttgaaaaagaacttacatggctaccttatctccaaaaaaatttaaccatgacaatttcttcgccaatagctaaaggttatccaagctgtggatatccattttcttggtcaatcaacaaatatatagaaggtgatactttaacaaagcaaaacattaataatttaaatgaatttgctgatgacctagctaaattcttaaaagaatttcagaaaattgatacaaccaatggtcctcaagcaggacttcacaactattatcgtggtggttatctagcagtatatcacaatgaaacaatcgaagctttagaaaatcttaaaaccgttttaccaactgagctgctactgaaaatctggcaacgtgcccttaatgcatcagtatctgatttaaatgtttgggttcatggcgatatagcccctggcaatttacttgttaaaaatagtaaattagcagcagtaattgattttggtgttttaggtgttggagatccttcttgtgattatgcaatggcttggactttttttgaagaagaaagccgacagcgattcttaaaaaaactagatcaaaggatgattgatcgtgcttgtggctgggctttatggaaggccctgatcacatataatagcgatgaagcagaacgtgcggaaaatgctcaatatacaatcaatgaaattattaaagatgaaaaaaaacttggttaaatccaagtttttttatcctttttgttcaattttatctaatgctttaataacatcccaacaaaaattatttggttgtgctaattctacgaaatgatgtcgcttgaattgtttcattacatttttttggactccagcaaataaaacattaatattattttggcgacataattctactacatcaataaactcccggatccctgaatcatcgattgaaggtacaccacgcattgaaaaaataatattattacattcatttaaaatctcattaacttttgtaattatttgttcttgatttccaaaaaacaatggaccagccatataaattactttagtcctttgatgatcataatttaactccttatcaagtcgttgtggttcaatatcacttgtttcaatatctaaatcagaattattgattacaaataaaatcatagatataaacactccaattacaattgcaactgtcaagtcaaatacaacggtcgctaacattgttactaagaattgtgtcatacttgtttttattcgtttcgaaaaaaattgtttaatttcatgccattcattcattttccaggcggtcgtaattaacacaccggctaaagctgataaaggaattcttgacataaatggacctaaaacaaacattgaaattagtaaagccgctgcatgaaaaatactaactaaacgcgtttgaccgccagctttaatcgcaacactcgttctagcaatagcagctgtagcaggaacacctccaaaaaaaggaataaccatattaccaatcccttgtgcaaaaagttcttgatcagcatttaacttttcatttttcatttttccagcactagcaccgcataaaagtgattcaatcattcctaacatagcaatactaaatgcaggaataattagatttgttattgctgttaaatttaaactattcaatgacaaacgagctttaggcaataatgtagatggaatactcccgacctctgctacattaaatttaaatactaaattaataatcaaagcaataataattccagctaatgaagccggaaatatatttccccattttttaggccataaaataataattgctattactagtatcccaaaaaacagtgcctctaaatttacattaaagcctaacatacgataagataagattttttcaatcggattgcttcctttcgaagtaactccaaaaaaattatcaatttgtccagttgcaataattattgcgattccactcgtaaatccagtaattacactagctggtataaatgatactatcttaccaaacttaaataatgaagcaattaataacattaccccagaaataaaactagcaacaaacaccccttgtaaaccatatgtagttgacaatccaattaaaattgctgacattgctccagttggtccagaaatttgatacgatgccccagataagccaccgatcaataatcctgctataatcgctgtaatcaaaccagccccagcatcagcaccactactcaccccaaaagccaaagctaacggcaacgcaaccgcagctacggttaatcctgccaaaatatccattactagcttttgaccattataacctgcaaattcttttttcaaacttaatacataatctttaaacatcctaccctttatcctttcaaaatacttttttattataatgataaatattagtgatttaaagtaaaaaataaatattttactgttttttattaatatttctaacttattataaaaatatcgataaaatcatcaaccataaaaagactactacttctactctaaatacattaaaagaggctataacacctaaaagtttaaaaaactttattccttatagcctcttttattcagcctctccaataatatcaattaatttagccaatggttcacttatatatttttcttgatgatataaaagctttgttttattataaagcaattcatctgtttccaccgtttttaaagtaccatgctttaactcctcagtaactaaaagagtaggtaaaaccgcaaaaccaaatccagccttacatgcttcaatcaggacctttgaatttacacttgtccatttaggatatgctgccaatcctcgcaaatataaacaactatcaataatatctctagttgcactccctttttcacgaagcaaaagatcatgagtacaaagttcttttaatgtaatttcattatccgcaaaataatctggtgcacataaaacgtttaattgataagaagaaaaatctattacaataaagggtcctggtggaactactccctctaccaaagcaagatcggcttctccacattccaaaactgctaacgcttcttttgcactgaccacttgcacctcaaccttaatattaggatagctgcttgcaaattgttttagaatctttggtaaccaaaaagttgcaatagtaatacttgaaacaacttttagaggcgcactcatttccaaaacatctatttgtttttctaagtcatgatatagtgataaaattggaataactttttccaataataatttccctgcaggagtcaatataattgcctttgataaacgatcgaataggacagcatttgtttgttgttctaattccctaatcgcatgcgatactccagattgcgtaataaataattgttttgctgctttagtaaaactccctgtatcaactactgttttaaatattaataaatgtctaaggttcatagctttctcctatcatgaataaaagtaatgtatttcattaaattatatcattttactaatgtatatacaacttatataatcttgatatataaaggagaatattaatgaaagcaaataaactaaaagaccttacatggttgttctttatcaatatttttattagcagctttacatttggaggtggttatgtggttgtatcaatggttcgtaagtattttgttgaaaaaagaaaaattttcaatgaaagtgacttaatcaccatgtcggcaattagccaaacaacacctggagcaatcgcaatcaatcttgcggcattagctggttataaagttgccggtaccattggaactatcgttagttgcattggagcgattattccgccaattactattttggcagttgtttcattatggtatcaagtttttagtacaaatcacatcattatggctatcttaaaaggaatgcaagccggaattgctgctattatcgtggatatcctaataggaatgacaagagctattaatgaacaacattcaaaattattaaccgcgatgattcctattactttcattgccagctatatctttaaagttaatatcgttgtaataatcttaattacaattatcgtagccactgctcaactatactatcgccggaggtactgccaatgttaaatttatttataattttctttaaaattggattattcagtattggtggcggctatgcaatcattcctttgattcaagaacaggtcgtcaataactatcattggatcagtgccaatacatttactgacattatcacaatttcgcaaatgacacctggccctttagcagttaatacctctacttttgtgggtattcaactagctggaattagtggtgctatcgttgctacaattggttgtatttttgctggagcaacaatttcaattatcctttatcttctttttactaaatatcaaaaactagaaataattacaaatattctaaatactttaaaagctacatcagttggtttgatcatgtctgccggtgcaacaattttaattctaacttttgttgaaaataactctatcaactttttagcaataattatttttgtaatttctttattatggttacaaaaaaagaaacctaatccgattgccctaatgattatcacaggaattattggatatttcgtatattaagacaaaacccggttactaaatctaataatgacctttgatttcttatttattcagctagttctaaaatgcctaactaaagattatctttatttccaatgaacattttaacaaaatcaaaaaaaaaactgcctatatgacattaagaagtgtctaatatgaatggttttggtcttgtctaatttaatatcaacaatccattttttacattacatcaacaaattagtcaatcaatttaatatagataattgtctagattctaaattactttattaataacgctgatattcatatcctaaactctaattaattattctgaatagataaaaataattgtattttttattacaaatatttatcacttctttgataattatcaaaatatttagttttagtatagctttcctaacattattgaaagataacaatcttacttctaatataaatcaatacttgacttcattgaatattgaagataataaatgtatacataattcaaaatacatgaatatctcattattaaataattttccttactaaaccactattcttataattgtgtgacctagttacagaactaattttaaattaaaattataataatcttgaaaatgaatcatagattaataattatggaggaaaaaaatgaatactaatcaaaaaattcttatcgtaggcggagtcgctggtggcgcttcagctgctgctcgtctaagacgtttagatgaatctgccaacattattatgtttgaaaaagatgaatatatatcatttgctaactgtggtttaccctattatattggtggtgaaatcactgatcaagaggctttaaccttacaaactcctgacagttttaaagcacgctttaatgtcgatgttcgcaactttaacgaagttactgctattactcctgaaactaaaaccgttactgtatataatcatcaattacaaaaagaatatcaggaaagttatgataaattacttctttcaatgggagcaaaaccaatcaagccaaatattcctggaatcaattcaaataaagtttttacacttagaaatatccctgatacttatgcaataaaagaatacgttgatacccataaaccaaaacatgcaattgttgtaggtgggggatttattggtattgaaatggcagaaaatttacattcaactggaataaatgtaacgattgtagaaatggctaatcaagtcatttctccgattgactatgagatggcttgtgaagttcatcaacatcttataagcaaaggaattaacttagttttagaaacagaacttcaagctattaatgaagccgataacaagctgacagttactctaaataatcaaactgtagatacagatatggtaattatggcaattggtgtggtacctgaaactaagattgtaaaaaatacagaaattgcaactaattctcgcggagcaatcatcgtcaacgataagatggaaacatcaatcaaagatatatatgctgtaggcgatgctattgaaatcaaaaattttgttactaataaagcaagttatgtacccctagcaggcccagctaataaacaaggacgaattgcagctgataatatttgcggttttgatcgccattatcaaggaacacaaggttcatcaattttaaaagtctttgacttaactgttgcaagtagcggaatcaatgaaaaaactgctagggaattaaatctcaattacgataaagtctacacatattcagctaatcatgccggctattatccaggtgcggtcaatatgtcaataaaagtcctttttgataaatcaacgggaaccattttaggggctcagatagttggttatgatggggttgacaagcgcatggatgttttagcagctgctattcgtgccaaaatgacgggttttgatttaactgaattagaactttgctatgctccaccatatggatcagcaaaggatcctgttaacatggctggttttgtaattgaaaatattcttactgacaagatcaaacaatataattgggatgatgttgcatcactgccccgtgatggcagtgtgattctattagatactcgtactgaattagaatatgcaaatggtcacatcgatggttacattaatattccattggattccttgcgaactcgtcttcatgagcttaatttaaataaacctatttatgtaacctgccagattggacttagaggctatatagcatcacggattttaagtcaaaatggttttgatacttataatctcaatggaggatatcgcttatataatacaatttttaatcaagaacatgatgaacccaaaatcaagacaatgcatcctgcttgtcccatagaaaatccagaaacaattaaaattaatgcctgcggtcttcagtgtccaggtccgattgtaaaattatcagcatcactagaaactgctaaagatggcgatattattgaaattcaaactacggacccggcttttgctacagatctagatggctattgtcgtcgtactggtaatgaactaatagagcttagctgtaataaaggaattagcagtgctaaaataaagaaaggacagaacagtatctcaaacggaaataaaaataataaaaatatgattgttttctctggagatttagataaagcaattgcatcatttattattgctaatggcgcagcggctatgggacgaaaagtcacaatgttctttaccttctggggactaaatatcattcgacgaccagaaaaggttaaaatcaaaaaaaattttatttcaaaaatgtttgcaatgatgatgcctcgtggttcaaaaaaactatcgctttcaaaaatgaatatgggtggtatgggagctaaaatgatccgtactattatgaaagataaaaatattgacagtttagaagatttaatcaaactagctcaagataatggtgttgaactaattgcctgttcgatgagtatggatgtaatgggcattaaacaagaagaattgattgatggtgttacattatcgggagttgctactatgttagctaacggtgaagaatctgatatgtcactatttatataataaaaggagcttggaattaattccaagtctcctttttatgattgtttcttttttcttaaaattccaattcctaagatgctgatcaataatgttcccgccaatatttgaatagatactgaatcaccagttttagctgctgaagtactatcatcttttggtatctctttttctggcgtaggaataactgttacatcaccttcaactttatcgtttgtatttacatcttcttttatcactaattgatctaacgcttgatacaattggtcatacatctcatcgacttctgcctgtgcagcattttcatcatcaataattgattctaccttctctaacaaggcttcaactttagtaagactttcagaagtatatttttctttatcaagtttcaatgcagtattaaaaattgatattaaattatttttatcagctttttcaactaatgctgcgactacttcatttaatttattaattgcttcatcaacttcatgtttcgtagcattatcatcattgaaaacttctttagctttttgtaaagtgactgtaagtaattcaattgattgaggggtatatttagctgtatctaattgtttacttgctgaattgattgtttcttccaactccattttatcaacaatcttagtaagtcctttaacactatcttccaactgatcaattgcttttaagatatcttcagatgtaacatcatcatcgttataaactttaacagcattatttaatgcttcttgatatcgcgcaatactattaggggtgtatgatgaaatatctaaatctttatatttcttataaatttcctgtaacttagattttaaagttgttccataaacttcaaattcccatagtgaatacccataatcacttccaacttcaatccctaacatccttacatatcgtcctgttacatctttatatgataattcatcaagacctccatcgccatcattaatatctgatatatctgtccaaacttgaccatcattagaaacttgcactttgtatttctttgcaccgcttccttcccaattcaaaataactttagaaatattataaatatcttgtaagtctacatatatccactcatcattagatttccgattagatacccagcgtgattgctttccatcaactatttcatttgtacctttaccatcaaacgctagcgaagattcatatgttttatttccatctttcgaatcaacatattctgagctcgcattcgaagatttattcaaagctaaatttacatttggattttcaggttctaatacagcttccccgtaaacttcaaattcccataatgaatatccataaattcctccaggctcgattcctaacattcttacgtatctgcctgttgtatttttatatgtcagttcatcaataccacctttaccatctgtaatatgtgatatgtctgtccaattctgaccatcattagaaatttgcactttatattctttagcaccatttccttcccagttaagaacaactttagaaatatcgtaatcagcttctaagtcaacatagatccattgtgatgttgctgttggatcatcttttgttcttaaagatacccagcgtgattgctttccatcaactgtttcatttgtacctttgccatcaaacgctaataaagattgatatgttttattaccatcattagggtcagtaaactcgctacttgccttagaggttttattcaatgcaatatttacttcaggcaccactggttcttggtgtaattttccatacacttcaaattcccataatgaatatccgtatttagaagcacattctatacctagcattttaacataccgagcagtaacagtttcattaaatgggatatttgcaattccaggttgtccattctcttctagataaaccttttgccatgtttttccatcttcagagacaagaatttgatattttttagcaccatttccttcccaataaagttttacacccgttaaatcataattcgcttctaaatctatttgaatatattcatcattcgaatttctatttgaaacccatcttgattgatcatttccaccattattttcaaaacttccatcaatagctctatttgcagtataaacattgttataaactgaagaagctgttgctgttttatttaaagcaatattctctaaattttctgcttcaacaagttcgccataaactgaccactggatgatttggtatgatgagccactagaaccatttaattttaatctaacatatcgtgcttcttgattacctaaatctgaaatgttctcattaccaccttgtccatcaattatagtttttactgtttgccacatttgtgcatcatcagaaatctgaatttcataattaggtgcataattatttccccaatcaacctgcatacttgaaattttataaattccttttaattctacatagatccattgatcaccggctgcactcgaaatccaagacgtattggctttattatcaattgcatgagtcggtaagttcaaatcctttattgtacttgaaaatgcatttttattagctgcaatatcctcatctttataagaaccatacacagaaatttcataaatactaataccatattttaaagttcttgatttatgtgacgaaactctaacataacgcccatatacaggttcatcaaaattgtattcatccaataagctacttccagttgccatactatctttaaccgttatccagttatttttgtcactagagacctgaatatcataatcatcagaacaagcggattcccattgaatgctcatagcattaatttccgaatattgtcccaaatcaaccatgatccagttctcatcttcatttcgtaatgaactccatcttgtacttgtattaccatctacaactaattctttagtatttccagggtcatttgttgacgtactgcttgcttcaacagatttattaagcgctattgaatcacttgctttaaatgtaatttccttaatttcaaaacaatttccatttccatctttcatgataatcttaatatatgggtagactccttttaattcaatcgtgtctgtcttaccatcaccattacttacagatttcaataattcataatttttaccatcttgagaaaccataacatcataagcactagcataattatcaccccaaagaatattcatagatgctaaatgtttattgttgccagtaaacatactgatccattcattttgcgtttcttcactttgccaatatgtattttcatcaccatcaaaagctttttcgacttcgtgtccaatcattgaagaattagtatgataacgattatctgagccttctgataacgtcattgtttgtccagcatatggtaatgctcctgaaacaaatgttgtttgtgtttcttgattatcataatttaaatttacatttacagtttgattggctgctgtatcattgactgctacagagatttttcttgtatcctctgattcatcaataataatactgcaaggttgatcaacagtaattatatagccatctttatattccaatgaaccagcttgatagaaattaatttgagtttgttttaaaccgtcatgtcttaccgcttgaactttttcgttattagcaattacagtaactggtgtattaccggcatattgactaactgcacctgctgtggtatttggtacgacaatataggcatagctatcattgcttggctttaatccatgatctaaataggctgtaaaagtagccggagtttcattcttttttgcttcatcccagaatgacggattattagtttgaacactattacttacaactacatccgtattttctaagaaaacatatccaacttttccattatatagccaattagtgttataaatttgttctttcgttccctcagccacactttgaccaccaacatttacatcttcagcttcgcattgatttaatgttgtatggatattgactccctcagtagaattgatccccgaacctagagcaacaaattcatcatcaaagaagaaatatcctttctttacttgagtcccctttttattcatatcataagcagtatttccatatttaccattggataccccaattgtatgttcagttccatttgtaaaacgacctgcattagcataatcttgaacgattcgtgctgctgttgttgttcctggacaatgagcccaatcatatgttggataaacgttagtatattcatctccgtcaactgtgattgttgaagctgctgatgatgtccaataaattaattgtcctccgtctttatcataacctgaccagctgccacgccattcaccaccgatgatttggttagagtccattttaatattaactccgtacccatctcgcatgtgagaagcataaccagaacgccacatataataattaccattttttccattagctgtattttttccttggatgttatcaaggattgcttgatattcatcagttcgatcaggatctgattcaatcattctcttaagtggatcgatatactctgctgcatagttatcatagccaacatcataatcatatggccgatatccaaggtaaagctccataatatctcctctgattgtccagcttgtcccatcaatcatataatcagccattaaatcaatgacatcttgttcaaatgcataactagtttctcttagcatataaatccaaaaactcatatctctaaacattgacattccatatccattagaatagaactgcctaccatgcatatagaaactgttatcaacctgaactgcttcagcagtattatcatcagtttgaacaactaagcaataacttaaataatcatctacaagttcttttaaatctaatttcttaaatcctgtagaattggtatgtttagtcccattttctgtaataattgcgtaataaacataattttgatcaaaccataaattattttgacctgtaccatatttaactggtgttttttccaataatttattaagcataatatccattgcatctttacttacaatgctttccataaataaagcaattctagaaaatcttaattgaactccaatttgattctcccaccagttagaagaagatggattcatttttccccaataaacaattgctttatttagcttattaattacttcttcgtcatgataaagagcgtttccctctttatgataagcaactgtaattgcttgtagacgatcaagagctaaataaggtgaccatgctgttccattagcagcacttgatgtcgctttgtagtcaacatccccaaaagcgccatcttcttgaatcaaatcaagataatcttttgcttttgaaacatagcatgtttctacttttgacccatcatcaatcgtgtctaaagttaaaaagtaatcttttaaacgcgttttgattgttgcaaaatcactctcacttgcataagttacattcatggaacttaaaacaagcccaaaagacataactaatgacaggattattctcaatgcctttttaatcatataatatcctccttttaaataatattgaaaacgcttactacatctattatttttagttattatcacttgaatttcaacgaaaaatcacttgaaaaagtttttttataaacctttataatcagtagaatatagttgaattataaatgatgaaaacgtctttaaatttttaaagacgttcgttcaactattttcacacttaataattgtgtcatcggaatattatctttacgatgaatccgatcaattagattagataccgccacctcgcccatcagttccttttgaacttgaactgttgtgatctgcggtactgatttaacacacaacggtgtatcgtcaaatccaacgacactaatatccttgggaacttttaagcccatatcttttaacgcagtaatcacagcaaatgcattagaatcatttgcacatactaagacctctggtaattttttagtattcaaaatttcaattattttatcaatttgattagttaaaacatattcttcaattccttgtagaaaagaatatttttgaatatattcatcaacctttgaataactaacaatattattctttaacagtgactgtttaaatccaataaaacgatcctcaaaactaaaggaataatcaagatctccaaaaaaaccaatccgttgataccctttattaataacatgcgtagtcatcatataactaccttgtttattatgcgtcaaaacacaatcacacggtgtacataatgatgtaaaatctactagaacaacgggtacaccaatatttttaagcagcagcaggttactatcagatattttgcctacaactaatattccagccactttcctttcttcaatacattcaggtactacgaagtgcccgtcttcaaaataatttaaaattgaaaaataaccaaatacttttgcttgttcaacgattgaccgtaaaacaatcgaataaaagtgtcctgtatctgcataataactttgcattaaaatacaaatatttgatttagaataaactgatagatattgtcttttttgattaatgtaacccattttatcagccatttttaaaatttctaaacgcatttcatcgctgacaccaggtttatcatttagtgcaattgaaacggcattaattgaaattcctaatttattagcaatatctttcatcgtcactttcatctttgtttcacctcattaaatagtatagcacatgctcctcgattatagtacttctccatttgatgcaattacttgttgataccaggcaaatgatttttttctaattctacgcatatcttttaaatcatcattttcacgattgacgtaaataaaaccatatcttttcttcatttgtgcccggctgcttaaaatgtcaaccggtccccatgacaagtaaccacggcaatcaacgccttcttgaatcgctaatttcatttcctcaagatgtttcctcatataatcaatacgataatcatcgataatttggccatctgcatttatttgatcattataaccaaaaccattttccactatatatattggcatttcataacgatcatacaattgtcttaaagtaattctaagaccagttggatcaatcgtccagccaaattctgacatttccaaataaggattctttttaattacaacatcattaatatttgttagactctcctcaccataatgtgaaattgtcgacatataataactaatagatagtgaatccgtaatccctttctttaatatttctaaatcaccatctaagatttcaggcattgttccttcatttttcatatttgcaaaataatatgaattataatgtcctcttgcaaaaacatctaaaaaaacataagcttcactttgagccttcatactttcaagtgtatcaagaggatgacaagtttctggataactttgaaccactgtcgccattcccataaccttaccacctttttgatgaatatattcattaataagactatgagcaatcaaagtattatgcataatttgattatcaaacgtttgagtatcaactccatccggacaaactgccccaaaaaacatttttggccctttctgtaaaattccattttgttcattaaaaataatccaattttcaactttatcatgataacgatcaacaatctttttgcacagttctacaaatatatcgactactttgcgactataaaatccattatacttctcatataaaaatgctggcatttcaaaatgatataaagttggaattggttgaattcctcttttaagcagtgcatcaataaaatgttcataaaacacaaatcctttttcattatatactccttcatcgctcattaaacgtgaccaatcaagtgaaaaacgataagcattaaatcccatttcctgaaataaatcaaaatcctcttcataacgatggtaactatcgattccgtctttaaaatcagaatattcaccggtaactgttaaatcacaaaccgctggtactttaccatccagtgtatatccaccttcactttgatgagctgtaactgccccaccccataaaaaatcttttcgtaacattacttcttcctcccattctatttctagcagtatagctattttttatataacaaattactattactgatatagatttattatctttaatgtcagcttgaatttcaactcataatcacttgaaaaaaaattaattaacttgaataaaaaagaataatcataatgattattccataattaatcaatagttagtttatctaatttatgtttatcaactattgttatttttcctcgtgatatttttacaataccctcttgactaaaatattttaacatcctagttacaacttcacgagccgtcgccatatatttagcgatttgttcatgagtaatttttaactctaaagaattattcttttcagcttcttccttaagaaaaatagctaagcgtttatcaacagacataaataaaatttgctgcatcgcccacataacatcagaaaaacgattggttgccattttatacccaaatgtttcaacataaatattttgcttcgccaattgttgaaataaagttgccgtgattgtaatgatttcactattttcttcaatatcaataaaaacatcaaatgtaatcgtttctaaaacacatgatgccgaaagaatacatacatcacctgcaaataaacgatatagtgtaatatcacgtccatctggtgataacatatatgtccgcaattgaccctttctcactaaaaccacacctaaacaatcatcactaccacgatgcattgttatgcctttagcataagtttgaaaggtggcattttgttttaataactctttttcgttttcatttaaatgatcccaaaaagttaagaattttgttaattcttgctccatcattttcaccctttcaaattaattcaaattttttaatgctttaaaaatgccatcatcattaatcgtgtcagtaacaaaatcactagctgccttaactaaatcattagcattccccatagcaacaccaactccaacatgttttaacatatcaatatcattattcccatcgcaaaatgccattacttcacctaaattaatttgatagtgctttatcatttgatcaattcccttattttttccgccatcaatagggatgatatccgcaaagagcgatgtccagcgtgctgatttacaattaggcatatatgataatcgttcactatctttagtctcgtctatatatgccattagttgaattatcttactttcaattatttcattaacagctttaatgggatagccctctttattcagtgatctagcagcttcatcaagacaataattttggatattactataattaccatttatttctacaaataatacgggaatctgatttttgttaatatatggtaataaatttctaatatcttctctttcaatatatttttcatgaataaccacttcatgattaaaacaatactgtccattacttgtgagaaaaccatcaaactcgaaacaatcttgaatcactttaagattattaggtggccgcccagtagcaacgaataatctaattccattcttccgtaatttttttaatgcttcaaaagtactagatggcattaagtgtgtatcatgatccaatagtgttccatcaatatcaaaaaattgcttttatcatctacttatcctcatattattttatcttttagttcttaacataataaaataatcgtctttttattataatgttttccaatacagtatagcatatgtaatccttcaattcataaaaagagaaagtaatagttactttctcttaactactatttgactaaatcaacaatcaactcagtacatttatcgattccaatttcaccactatttaaacataaatgataattttgcgctaacccccaaacttgatcagtataatatttataatttgctcgtctttttttgtctttatcagctaaacgtttctcaggcttctcatctgtttccccatataatctgacgatccgttccacttttttatcaagatcactacaaataaagacattaaaacaatcatctcgatctcttaaaatataatctgcacatctcccaacgattacacatggtccttcttgcactaattctaaaataatctttctttgcatcatccaaatataatcattcattgacatcccatcaatataatgacctaaaaaagcataagcaaaaggattactagatggtgcatattcaccatgttcttcaatataattcacatttaatccactctctcgagctactttttcaattaattccttatcataaaaaggtatgtttaatcgttttgctacctctttaccaattgttctaccgccactaccaaattcacggctaattgtaataatgttcttgcgcatgatctgcacctcctcctaatcttagtcattatctatactttaattttactactttacaagcgaaaagtaatgagaaatcactaattttattgtccaaaagatattttttataccattcatacaataaactataccattcatacaataattaaaatatactaaaagtaagcccctataataaaggtgtaaaagataactgcaagtaataaaggagatttctaaatgaaaaaaattggattaatggttgttgataatagtgtgatcaaacaattaaaggaactaatcattaaaaatattgacagtgaatatcgtatcattgagattcatgataaggaaatgttatttacaaaaaaaatggatttctgtattattgaagattcttttgataatcaaggaatcaattatgctaaaacattaattgaaaataataatgatatgcttgtactaattatctcaaaagacggttcaactattttcgatgcagtaggtattaatatttccagctatctgcgctatcaagatattaaagcgaaatttgttccagcaattcaagatatcatcgattatcttgataaacgaaaattactactatttaaaagtgatcagggcatcgtcaatacccaaacaaatgatattgtttattttgaatatttaaatcgcatgacatatctaaacacattagacaaaacatatcgcatttttattcaaaactttgaatatctacaaaaaatgcttccaaaaaccttttttaaaatctcacgttcagcaattatcaatatctttagattaattactttaagcagtgaaaatgtaattatgaaaaactacgaaaataaagatattgctatttcaagaagaagatatcaagatttacttgtagtgttaaaaaaacatgctatttcttttacagaaaggaaactaaaaaaatgaaaacactatctacaaaagcatctaaacaaaaaatcttatctttattattattagctggtttatggagtatcatgctgatcattgtcttactcgcagctaaaagtacttgggccaaaaatttaaatagtccttattgggctccagccatcattacaattggaataattttctttatcacttacttcatcttcactgtaagagcgttattttaccgccagcacggatatgataatcaatatatatattattataaatcaacaagttattttaatatccttaaattaattattaatacgctttttaataaagaaatgtatcaagataaaattgcctttaaggatattaaaaaatgtgaaattggatggtataatcaaacatttagaatacactcatttggaagtgaagtcgctcatccaatttattttaagattaatgaacagatggttattaaaacggatttaacttcaaataatgagcatattattgagttagctaatcttcttaaaagtcatgtaaaagactttaaagatccctaccatttagttttagcaatgaacgatcgcagtattactgtatacgaatatattgaacgtatcattcataacaaaataatcaaaccaaatctatataaatagacgtgcgaatatttcacacgtctattctttattattcaaaatttaaataatatatcataaaactatcctgctcacagttttcccaagactacttatacaaaattgataaattttataattaaatagcaccttttcaaacaccctattactatattcaaattttgatttgaacttttcataacaattctttccaatcaattttcaaacttatctaaacatatattattactatttcttataaatttccagtattctacaaaagcttttgtttcacacgtaattactctattttctcctcaatataagcccacaaacaatcctcattatcattttctatcgtatagttcaacaaccatatccaataatttaatcttttttatacgttccttcttagtttcccatttttctaacaatgtgggggcaaataatcttttaatgtttcatgatcttgatttgaccatgacatttaaatcgcataataacgattttctacttttttttattcgttcctcattccaaaaattatcactgctatctaaaactaacaattgttttttataagtcgatatatttttagagctttcatttgatgttgaagtgccacactaataaatgtaacaatgaaaatatcagcaaaaatcagtacactaatcatgcataataattcttaatcatcatcccctcttaaatgttaaattattcaaatggataaatcattccccattgagtccgaatttgacttagcagtgaacttacatcccgagttaactgtaattcatattcaccaagattatttataatataatcttgcatatcaataacttcgtattgtagtccctgtttatcatcaccacattcaatgacttcctgatgaccatctttagtataagttatcgttgcttgattactccgcggataattattaatttctatataccccaattctcctgatatgaccccacgcttcggttgttttgcacgcattgttagagccattacaaccatttgaccatcttgatttttcataatgattcctgattgttcatcaaccccagtttcaaaataatcagcagttgtaattacaacattaggttttgatgataaaaagtaccgggcaaaacttgttgcataaacaccaatatctaataatgccccaccagctaattcttttgaaaagaaacgattattaacatcatattctttacagctgccaaaattgacttgaatcatttttacatttccaattactcctgcagcaaccatttcctttaattttttgtatagcggcatatggaaaattgtcatagcctcttgtacaacaacattatttttcttagctaaagcaacaatttcttccaattgacgatcatttacagtaattgctttttcacataaaacatgctttttcactgctacagcctgtttcatgatttcataatgactattatggggtgttgcaatataaacaacatcaacatcaggatcatttaataattcctcaacacttccataagcatttttaattttatatttcattgcaaaatcaattgctttattcatatcacgatgtccaaccgcatatatctccccatttacatccaacaaagcctgagccatttcattagcaattacaccactgccaataattccccaatttaattttttcattattatttcctccgtctaatcttcatagatatattatacatagattacaaatagaaaaactagcaagaaaataattttctcaccagtttcataaaagcctatctttctgacattttaaaatctcttaaagcttaataaaaaactcaaaaatttaaataaagtattcattttccctaggtgttgccagtttcttgctaaagctttctgcaaatgtttgatattcttgattgttattcatactcttagcatggactgggcaaatacgaatacatctaaaacaagcaatacaatcattattaattgtcttacaatcttctatatcaatagcatttgtaggacacatattgacgcaaaccccacagccgctgcactgttcattagtttctgggcgaaattttcccccagttcctccttctttatatgggtatttccctggtactgaaacaaatgaaaaattatcatctttaatttttagccgcaccaaactaccaaacaattcatcacgatataagtcatcacgattaggacgacccacttgaatttgaccataagtatgttcacccactaaagctgcaccagcaataggaataaatccttgctccttaacagtattaaataattctaataatgcatcatcataatgacggtttccatatgtaacagtaattacacatgatgtatgatcaccccgaaatgattttaaccgttccaaagcctcgtgaagaattcttccaccgtaaaccggaaaaccaaaaactacaatatcatgacgactaaatgtcatctctggaatcgttccttctagtgttaaatcaatttcacttaactctccctcaagtccacgagcaatactaacagctgacttcttggaagtgtaagttggtgaaaaataaattgcatatgtccgatcaatcttcataatatatcctcccacctttatttattcttttattatatcattaaaatatgtactatctattaattaaaaatagattatcacaataaattgtattatgattaaactagaggtgatgaaatgagtacctattttataaatcgtataactattgatcatgatttaatcgagcgaaacagttatctaaatacaattgctacaattaaatactttgatttttgataatccgattaccttttttgttggagaaaacggcacaggaaaatccactttattagaagcaatcgctattaaatatggctttaaccctgagggggaactttgaactttaattttcacactaacaatactcattcatctttgcatcatacaataatccttgatcgtggttatcgtcgtactgatgaaggcttctttttaagggcagaaagtttttataatgtcgcaacacaattagaacgatataaaaaaatgtttttaatccctatcgctattatggtggtaaatcattacaccagcaatcacatggtgaaagttttttaacattgattcaaaatcgttttaatcagaatagtctatatattcttgacgaacctgaagcctcattatcaccccagcgccagctaactttattaattactatttatgaattagcaaagcagggctcacagtttattattgctagtcattcaccgatcctattaggaatccctggggcaaaaatacttaattttgactcaaaagagataacacctattgattatcaagatactgagagttatcaaataacagaactctttattaataatcgtgccggtctattaaataaattattaaataaataagatcatctaccctttcaatatgattttatttttataaaaaaactagctgcataagcagctagttaagccatttctgttaaatcatcttttatttcatcaaaagcaacggcaatgtttaaaccatgatcaccaattctttcaaaatcaattaatgtttctgtatataatgcactatgttccggcgtacattttttatctcgcaaacgtcttaactgattaagtgaaaattcatgtgttgtaatatcaatactatcttcaataacatcaactttttcaacaatgttatgaagttcatcgcgatttaagacatttaattcctctaagatatttcttgtcaggtcattcataattttaatttctctcatcgcttcatctgaaaaatgttcatcttcactatataatttctcagcacgttcagcaatattaaccgcatgatctccaactcgttctaaatctccagccgtttttaagaataagccaattgatttagaatcatcgattggaaattcattagaaatagcattggttgtaaactgaataatttctttgtttaaataatcaatatattgttcatcttttaataatttttcatgtgtcttttcatcatacttaataattaaatcaaaagctctttgaacatttttttgaactatatttaacatattttgtgtttcattaaataattgtgtgttagcgattgcactagttccaatgtgataatcattggtaaagatactattatccaagaacttaacagataatttatcttcaaaaccttctttttcaggtaaaaccaaatatgacaatttaactaactgcgccccgaatggcagcaataataatgttgtaacaacattgaataccgtatgtacattagcaatttgtgccggaatatttgttggcgtcaatgactgcataaatgatgcaaacggtgttaacatactaataaaaacaaagacgatcgttccaataatattaaatgaaagatgaatgatcgttgtacgttttgcattacgccctgttccaatactagctaaaacggcagtaatacatgtaccaatattttgaccaaataatacatatattgctgatggtaaagtaattacgccactcatcgctaaagcttgcaaaatcccaaccgaagctgaagaactttgaattatcgctgtgaatccagcaccaactaaaataccgattaatggattttcaaacgtagtgacaagattaacaaattccggtgaacttctaagcggtaccatcgcactagacatcatttccattcccatgaagagaattccgagtcccgcaataataccaccaattgcatcaagttttttacttttgaaaaaagcaattaaagcaacaccgacaaatgcaataactggtgctaaagctgtaatatcaattgcgatcaattgacctgtaattgtagtaccgatattagcacccataattacccaaaccgcattttccaatttcatcaacccagcattaacaaacccaacagtcatgactgtagttgcagatgatgattggattactgcagtaataactgctcctactccaacgcctagaaagcgattcgtcgtaagtttttctaaaattgttttcattttgtttccagctgctaattcgagaccatttgacatcatcgtcatcccgtataaaaatagcgctaaaccaccaaacatagcaaagaaatctgtaagttccatcttattccccctgttacacggttactttaacataaaatttacatactgcaaagattgttaacaaattcttaacttttctttacatatttttacgcattttattaagtttattcaattttcttgacaatcctccaatttaagatactattactatagacagttcatttgtaccatcctgtctataaacaaaactagggctatgctttttatgttgtttttaagcaggctttttagtgagcctgcttttttatttgatggtatagaaggaggaaagatgtattttttaaaaacggaacaaagttttgatagtgcacattttttagctggttatcatggtaaatgtgctaatattcatggtcatcgctggaaagtcattgcaactatcaaaagtgaaaaactgctagaagatccccaaaataaaggaatggtaactgattttggagatttaaaaaaagatttaaaaattatcgcagatagttttgatcatgctttaattattgaaacaggcagtttatcagaaaaactataccaagcactgatcgatgaaaatttcaaaataatcaacttaccatttcgtccaactgctgaaaatttagctaagtatatttacgaggctttaagtaaaaattatttagttgattgtcttgatgtatatgaaaccccaaataactgtgcaagttatcgaggtaaattatgaataattataaggttgttgaaaaatttattagtattaacggtgaaggaagtcgtgcaggtcaattagccgcctttattcgttttcattattgcaatttaaattgtagttattgtgatactaggtatgctaatgattcaaatagcaattatgaacttttaagtgctcaaaatatcctagattatttaaaagcaaataaagtcgttaatgtcactttaactggtggtgaaccattacttcaacaaaatattgattatttaattgatttactgcttaaaaatggttttagtgttgaaattgagactaatggtagtattgatattaaaccctttattaaagaaactcgaccaatctttactttagattataaagtacctagcagtacaatggaaaatgaaatgtgcttaaataactatcaatatttgactaaaaatgatgttgttaaatttgtagttagcaatctcagtgatttaaataaagcaaaagaaataattgatacttatgaccttgtcaatcgtaccaaagtttattttagcccagtctttggtaagattgaaccacggaggatcgtcgattatatggtcaaacatcatctaaatggtattaatatgcaactacaaatgcacaaattcatttgggatattaatcaaagaggtgtctaaaatgattgatactaaaaaaatagaggaacacatctacggtattcttaaagccttaggtgatgatccagaacgcgaaggattaaaagatacgcctaaacgagtggcgaagatgtatggcgaagtttttgctggaatgaactatagtaatctagaaattgcaacgatgtttgataaaacatttgttgacgatttagacttcgataatcaagaggttgttgtaatcaaggatattgatatctttagttattgcgagcatcacctcgctttaatgtatgacatgaaagttacggttgcttatattccttgtggtaaagtaattggtcttagtaaaattgcacggattgctgatatggcagcgagacgtctacaacttcaagaacgaatcggaacagatattgctgaaattattagtctagtaacaaactctaaagatatcgctgtaatcattgaaggtaaacatagctgtatgtcatctcgtggaatcaaaaaagttaatagcactactgtcacaagtactctaaccggtcgttttaaaactgatagtaagctgcaaatttatttacattaaggagtagtaagatgaaagtattagtattatttagtggtggagttgattccaccactgcattagcactggcaatccaagaacacggaaaggacaatgtagttgctctttcaattagttatggtcaaaaacataccaaagagatagaagtcgcaaataaaattgcccaattttatcaagttgaacacttgtatttagatttagcaaaaatcttcacttatagtaattgctcattactacaacattcagataatgagattccccacgaatcgtacaatgagcaattaaataaaacagatggcaatcctgtttctacttatgtgccttttagaaatggtttatttttatctagcgctgctagcattgccctttctaaaggctgtaatattatttattatggtgctcatagtgatgatgcagctggaagcgcatatcctgattgtagtaaagtttttaataatgcgatgaaccaagctatttatgaaggcagtggccatcaattggaaatcaaagccccttttgttgaaatgaccaaagcagatattgttaaaatcggtctttcattaggcgtaccttatcaattaacttggtcatgttacgaaggaaatgataccccttgcggcacatgtggtacttgtattgaccgccaaaatgcttttttgaaaaatggaatcaaagatccattattaggagaataaaaatgacaaaaaatttaaccttattaggtaatcaaaacactgtttataaagatgattatgcccctgaagtattagaaacttttgataacaaacatcctgaaaatgattattttgtaaaatttaattgccctgaatttactagtctatgccccattacaggacaacctgattttgctactatctatattagttatgttcctaatcaaaagatggtagagagtaaatcattaaaactgtatttattcagttttaggaatcatggtgattttcacgaggattgtatgaatatcattatgaaagacctgattaaattaatgaatcctaaatacattgaagtttggggaaaatttacaccacgtggaggtatttcaattgatccatattgtaattatggaaaaccagaaacaaagtgggaaaccattgctttcaaccgtttagctaatcatgatttatatcctgagaaaattgataatcgttaaatataattattagagacctttttcaaggtctctaatttgttttcaactttacatcaaagagttagctcaaaaaaataatatattttaaaaccgttgacatcatattaatcatcatttatacttacattaaatacttttataaaactattttatataagatgtctggaggaagaaaaatgaaaagtgcagtattttacggaaaacatgatattaaggttgaagaagtagaaatgccacaattaggtaatcaagatgtattaatcaaagttatggcctgtggaatttgtggtactgatgtccatatttatgagggtgataaaggagcagcaaatactactcctcctactattttaggacatgaatttgctggaatcgtcgaagctgtgggacatgaagtaaaacatgtaaaagttggtgatcgtgtctgtgtggatcctaatcaactatgcggaacttgttactattgtcgtagtggtattggtcatttttgtgaagatatgattggcatcggaacaacacgggatggtggttttgcccaatattgtgcagtcaacgaatctcaagtatataaactagccgatacaacatcatttgaagaaggggcaatgaccgagccagttgcctgctgcttacatggtcttgacatgtgcaacattactccggctagtacagttcttgttattggtggtggcatgattggtttgttaatggttcaattagcaaaattagctggtgctcatgaaattatcttgtcagagccagttgctgttaaacgtgaaatggggcttaagatgggtgctactttaaccgtcgatccaatcaatgacaatattccagctcttttagctgataaaggaattcatcgtatcaacactgttatcgagtgtgctggtctacctgcaacaattaaacaagcaatcagcttagctggtaataaatctgtagtaatgatgtttgggctaactaaacctgatgatgaagtggctatcaaaccatttgaaattttccaaaaggaaattgaaattaaagcttctttcatcaacccatatactcaacaacgagctttagacttaatcaatagtaaaaaaatcgatgttagttcaatggtttgtgatatttgcagtttagataaattagccgatattctttcaaaaccagaattaagaaataaaggtaaatatattattaacccatggcaataagaatgtacaattttatgtacattctttttttgccatatatgaaaaaaaatggacattcgccattttgtcggttaagatttaactgtaaggagaacgaatatgaaagatattgaaaatgtatgtttagaagttgatgagttagatttcgacaactatagtccaattagtccagatattgttttaacatcatcatttaaatttaaaaattttgaccactatgtgaaagtgaatgctaaagaagaatttgcttatacatacacacgggacgggaatccaacacttaatttactagaaacaaaattagcacgtttagaaaaaggcgaagcagctcaaatgttcgcctcaggaatgggcgctatttcagcatcaattttaaccttagcaaaagctggtgatcacattatcattgttaatacagtctatagctcatcagttaaattaatcaaacaattatcaaaatttggaatcgaaagtactaaaattgatgtcagtgatactttagaaatctttgattatgtcaaaaacaataccagtatcatctattttgaaagtccatcatcacaaaaatttgagatgttagatttagaactaatcagtaaatttagcaaagataaaggtatcttcacgataatcgataatacttggtcaacaccattattacaaaatccattagttcatggaattgatgttgttattcactcatgttccaaatatattggtggacatagtgatatagtcggtggagtcgtaatttccagcaaaaaaattattgatgaaatagttgaatttggacaagttttactaggcgcaacgatgtcaccaatgaatgcatggttagcacttcgtggtctaagaacattaccggttcgtctaaaatcacaacaagaaacacttcaacaagtaattaattttctacaagaggatcctcgaatcgaacgaatttatcatcctctttgtaacggagagcaacaaaacgaacttgctcataaatatcttaaaggatatggtagtttattaggggttgtcttaaaagatgcaaatccagaaatcattaaacgttttatcgattcattagaacattttactttagcctatagttggggtggttttgaaagtttagtaatgtcagtttataaaggaaacaatattaatgagataaaagaacgtggtctatctttaggacaacttcgcatgtatatcggacttgaagatagtgaattattgattagtgatttaaaaaatgccttggatcaagcatatcagtaataaaaataagggttgagcaatattactcaaccctttctttaaataaattgaccttgaggcaaatccagataaattctcgcatttaaaattttttgtccattaacttgagctttatttgaaaaaagatgtattagtacaataactgcaagtttattactagatagagcattattatcacgattagcaattaaaacaacattatttgccacctgccatttgccattacaagcataaaaatcttcaagctctcgtttacacgtaaaaattccaaaatctaaattatcctcaatccatttagtcgctgtttgaactatttttgaacttaatccctgcctacgataatttggcaaggtagcaatacaactcaatccaccaatttgatatttttcattatctatcgttgtttccatccgaagaactgctccgtaactaacaacctgattatctttcatgatatagaatgactgcactgtaagttcttcgttatgggcatcattacaatcatcactaggccaaacaacatgtaaaagatgtacaatttctctttttatttctttggacatttgataatagtccaaagaataaacagtaatttcttccattatccaagtaattcttgcaatgcattaatgtctgcaactaaataatcactattacaagccatcaattcttcttttgtcccataaccatacaacactccgatacaaggtaaatcattttcatgggctccaatcacatcatgctttcgatccccaaccataatcgcttcatctttatcaatcatatttgctgttaaaacataatcaattacttcagcctttttttctcgtccattaaactcactaccgccaacaaaatcaaaatacttagctaaaccaaaatgttctataatttctttagcaaatttttctggctttgaagtagcaactaacaatacttttccctgatctttcaaagtttgcaaacacacttcaattcccggatatactttattatcaaaaattcccttggttgaaaaatattcgcgatatttaactactgcctcttcggcttttaaagcatcaaaaccataaaattcttgaaaagaatctcttaaaggtggtccaataaaaggtaacaaatcatttaagtcattaacttcgattccataataatttaaagcataacgtactgatttagtaatccccttcatcggatcagttaaggttccatctaaatcaaacaaaatatattttttattcatataagtcctccactacactaacttatattttatccattattccctacattagcaactatatatgcccttttatctgtagtaattaataaatgtttttgatcaatgatcattacttcttttaattgctcatctaattctttttgtggatccaaatcaactaactgattactttcaatatcataaagataaagtttttcattattaaataaaacaagataatctatgctacaataagttcccatataattagtaccataaaaatgataatcaattcttgaaacagcgcctgtaataatatttgttaacttaatcgtttcatcactatattcaatattgacaatcgttccttccaaaggatatttatctaacgttctaacttcatttgttaaaatattaattaaataagaatgtccattttcatcataagtaacaacagtctgttcatcaataaaagtaatacaattactatgcatatatggatcgatatttttaatgagattggtttctccagtttcaatattataattttcccacccctgatcactcttattaattaaaatattagtttgttgtggtgaagtaattggatttactgaaatattatcattagtaataaaacttatttgcttactttctaaattaatcttagcaatatttaaagcacgctgctctccatcattaatatcgacacaaacataaatatcattattaataattttaggcaaaacactatatatacatccattaaaatcaaatgcaactattcgctcttgataatccgcatatttaaaactgaattcatgaccagctatactcccgtaatactcattaataggacattctcttatttgttcattttctaacgtaaaaactttaagaaaattataatcctcatcaatgattccaaaaaattcattttcagcacgccaatgcccataatctagttttaatgtgggagtatttttgttgattgaagaaaattcaagagctgaactaattttcaaattactgctaaatcgctgactcaaccaagtacgaaatgaatcagaaaatgcataagtaattcccaatgaagaaattcctattgtcataacaattaaaacaattgcaaatatatacttaattctaatcaccttcgctctttttgtcggttcaaaattagttgcagtcacttcatcgatccagtttctaggagtttttattaagtcaaattcattaaatttattcataaaaatcatctcccaactttttctttaacaattttcttcccctaattaattgtgattttatcgtattgtgattttcttttaaaatagatgcaatttcattagttgaatatccttcataataatacaagtataaaacattacgatatttacttggcatattcattacaattggtagaataattaaacgctgatcttcttgacctaaaatcaacttatcaatatcaatttcccttttccaaaattgtttttgataatctttacattcattgatagttaccctaatcaaccaagcttttaaatgttcctcactttcaaatttcttgttgtaacagtataatttcataaatacattttgatagcaatccttagcatcatcataatttttaacattcataacagcaattctagtaaccatgtcactatactgatatacaacttcttcatatctttctttttccataacgatcccttccactatgaatacgattaaaaacgttcaacgggtgcattaataattattttttatactttcattataatcgattgttttacttttttatcgatttagtaaaataaaacagcccaaaaggctgttattgaagaaaatcgtctttacgctgaactaattttctaacaaattctgttttaggatgttctaaaatttctcttggtgatgctaattgtacgactttaccttgatccattaccataacccgactacctaatttcaaagcttcattaatatcatgtgttacaaaaataatcgtgatattttcttgatgatgaattcttaaaatctcatcttgtaaagtagaccgtgtgatttcatcaacagcaccaaatggttcatccattaaaagaatatctggggaagcagctagtgctctagcaatccctactcgttgctgctgcccaccacttaattcactaggatatcgatgaattaactcttcatctaaccctactattttcatccattttgatagtgcttcataagttctttttttatcatttttatttaataagttaggcacataagcaatattttgagctactgtcatgtgcggaaataagacacttccttgaattgcataaccaattcctcttcttaattcaattaaatcaactgcctgtgtacattgatcatgtacaagaacttgtccttcatcaggaattattaaaccattgatcatttttagaatagtggtttttccacaccctgaactaccaactacagttaaaaactcaccaggtgtaatttttagattaaaatcatcaataattactttttcaccataaaccttttttacatgtttaaattcaatagctgtatccatatgttcctcctatttcactaaattaatgctaactaaaaattcgtgagccacatcttcagcatcttgtccttttgtttcaaccaaatagttcaattgtgccatttttgtttcattgagaataccagtaagtttatcaaaaacattatttaattctggatattgttcaagaatttcattgcgtacaactaaggcccccatcgaagttgaaaagaattgttgatcatcttcaaggacaacaacatttgctgttgatagttgaccatcggttgtaaagacatccatgacatcaaccttaccttcatttattgcctgatattttaaaccaatgtctaaatccatagtattcttaaaagtaaaattatatttttggcatagtgcatcataaccctcaggaatttcataaaaatcatattcagctccaaaaactaattgattagatattcctgctaaatctgaataagtttttaaattatactgctcagcaatctcttttcttactgctaaaccatatgcatcactaaaccctaacagccctgtccaggtaaattgatatttttcttgatattctttaactagctgttcatacattgtttcattataaaaaccttcatgttttaaaactgtattccaacccgtactcgtatactcaggatataaatcaaactcaccgctaaccattcctggttgaatatttgaagttcctcctcctactccttgagtaatcttaactttaatatccgtatcttgttcaatcatttctttcaacattgctccaataatatattgctccgtcataggcttagtagcaatatttaaagttactgtttgattaagattgcctgaaatcattgatatgatcaagactgcacaagttgtcacaatcactactaagccatactttcttttagattttaaagtagcttttcgaatggtaaataacttttcaataaagcctaatactatatctgtaattaatgcaagtattgcaatcaataaactacctgtcaaagtcattgccgtgttattggtagtaattcctcgatatatcgctacccctaaaccaccggcaccaataaaagaagcaatccctgctaatgctattgtcatagttaccatatttctaaaaccagacataattactggaagtgccaacggtaacttgattttgtataaaatttgccaacgtgttgatcccatccccgttgcagcttcaataatattatcatcaatattaataattccagtatatgtatttctcaccattggtaataatgcataaacacttaatgcaatgattgcggtactattaccaattccagaaaaaggaattaaaaaacctaatagtgaaatagagggaatcgtatacataaaattaataattcctaaaattgttttagaactttttttatattcactgattattactcctaaaatcaagcctataacagtcgcaataataattgcaattagcgatatctgcatatgttcaattaataattttaaaaagaaatcccctttttcttgtaataaagatagcatatctcttaacataatctaacctactttctcaattgcccgcaccggacagttttcataacataaaccacaatgtaaacaatgatcttgcattattttatacttgcttccacttttaatacattgttgtgggcattcacgcttacagcgatcacaagcaatacacctattactaatcagatatcctttattaaaaattcgattatcacaaagatcatattgtgaacgttcaattggtacttttgataaatcaaatatttcaatttcaccatcaaaaatacaaaatacttctaaaatattacgactatcacctggataaacctcattcatactcggattatcaataaatattttttctaaccattctttttgattactgacttttttaacttttccttttaaacgaatcgatgcataatcttttgttagcgcaactaatgaaacgaaatttttatcaagtaattcttgataaaagtttttcccccgagcagtcaaaaaatacaaattattattttccacagccattacatcgatgattctaatttgtggatagccgtcactgtctacagttgccattgctacatcttttatttttctaagttcatttaaataatcattaactttcatcactcttacctccgctcgtctttaatatacactagttgatttttatatgaaagaaggcacttttttgtaacctagttactttaacgaaactaaaaaactatagctagtcgtgtacaacttcatagctatagctctaataataatcaaacttatactctataatattgtattaggcacaccataagtatactgttctaatatcaaaataacaaatcatatgcctaaaataaactactttgcaaaaaacctgaagtaatcgtcaaagactgtggtactgtccttaaaagtgcttcaatatgacgattttctaaccagtcatgatttaaatgctcctctaaaatcaatggcattcgatcatgaatctcacacatacttttatttgcttttgttgtaacaatagtcacttctgtttgcccgttaacatttcgataaattcctgtcattaacaataacgatcgtttttcgttttcaaaagtgaacttatgtttatgaccgtcccattcatagaagccactagctggaataaggcaacgatgagtaatcacttcttttttaaagaatggtttttccaataaagtttcacttcgcgcattaataattaatttattatcaaaagtactaaagccccattttgccttttttaattctaatttattatctcgatcaataatgattggtacaatattacttggataataatctttagcaattaataaatcacgttcaaatgtatagtcaattctttcttccaattccatcaaggcttttaattctaaaaaatatctgccacacataataatctcctattttaccaattcacattttaaaaactctaagatttgcgcatttaatgaatcatcattttttatctcacttaacatggcaacttcattacaacattcaccacatatatcaatcccaataacatcgccacgtttaattaaatctgctaaaattaatttaaattcaattaaccgcatctgcccctgctgccaatcagtcgtgactacttgttcacttaaaacatctttatcaattgaaaaataaacaggatattgtttcaaaagttcatcaattatcttccaaacttttaaatcaccaagattattatcacacaaataaataacgcgctccctatacttaggatcgattaaatcaacttgttcttgtgcaattccaatcaaaatgatctgttttaaatattgattattttttaaagcatttaagatccatgatccacagcttaaaatatccccaaacatcggtttaatcatatcactatgatgatcaaagactattaaaataaaatcataatttatcttccttatccaaaattcacttacataatgaaaattacctgaatcaataaaatgtattcctgcaggcagataatcacctattcttttaatgatcttcgcttttgcctcctcactgcaataaccacgtgtccccttaatatctaaacaatcaatccaattaatatttttatgcttataaaaactttctaactcataaataccagtaaaatccatgacagttaatttcttttcatttacaatacttaccccataaaaccagctccatttaatgcttataacaaaaacattctaattcatgatcatcaacaatacctattgcttgtaaatatgaataaatagttattgagcctacaaaactcattcctcttttttttaaatccatcgaaatatcatcagataacttcgttgttgttttaaaattattatccttatttttaataatttgatggttactaaaaccccaaagatagtcagaaaaactaccaaattcagtttgaatacttataaaaattttagcattattaattgctgcaccaatttttcgtttacttcttattattttttcatttgctaataactccattacttttttatcatcatagttagctattttaattacatcgaaattatcaaatgccactctaaaagcttctcgtttttttaaaatagttatccatgataatcctgcttgaaatgtttctaataagaacatctcatataatttttcatcatcataaaccggtacaccccattcatgatcatgataatttttataaatttctgacttttcatctacccatgaacacctttttaccatcatcattctctcctttttaactattttatcatgcttataagaataagcaaatattacacaaaaaaaactatcccagttaaaattactcattcatcatatttaactttttaaatattttttccagcagctaaaataataaattatattacttttaatattgtttagtttttagtacaatatttcaagatgttagaggagatttaaaatgaataacaataataatgatgtaacaaaaaaatatggattatttacagccattacaatgattgttggaatttgtattggctcgggtatattctttaaaagtgataatgttttaattgctacaaacggcagtattgcactaggcgtgctatcatttatcttagccgcaatttcaatcatttttggttgtcttacaatcggtgaattagcatctcgcactgataaagttggagggctaatctcatatgctgaaatgtttttaactcgtaaagttgcatgtgctatgggctggtttcaaacctttgtttactatcctacaattacttctgttgtagcttgggtcattggagtttatataaacatattatttaatttacaagccagtttagaatttgaaattttaattggttatatctttttactactttgttttgtttacaatattcttttaccaaaatttggtgcttttatccaaaatagtacaaccctaataaaactgctccccttatttattttaggaatattgggaattatttttggtgatcctattaatggtttagcaaatactagtatcaatacactaagtggtactgggtggatttctgcccttggtcccattgcctattcatttgatggctggatcgtaacaacttctatatctcatgaactaaaagatgctaagaaaaatatgcctaaagcattaatgctaggcccattaatcgttttaagtatctatgttttatactttattggtatctcatgttatgttacacctgaagtagttatgactttgggagatcgtcatgtcagtttggcagcacaaaatttatttggtccagcctttagtaaaatgattatcatttttatagttatttcggttattggaactgttaatggtttagtcattggctatattcgcatgccatattcattatctttacgtaaaaatatgtttcccttttctaaacatttgcgtaaaatcgataaacgttttcaaatgcccttaaattcagctatctgtagcttgattatttgtacgatttggatgttcgtccattatttatgtactaaatacaacctattatataatagtgatgtatctgagggagctatcggaatatcctatatcttctatactttattatatataagggtatttaaaatgtatcttgataaggaaattaagagtaaatttaaaggtttagtttgcccgattttagcaactatcggctcattgattatcctatctggaggtattcaaaataaactatttattttctatattatattttgtattttactttttctatactcattatattactatcaaaaaaataatcactaaataataaaccatctcttagaatcaagagatggtttattatttataaagttgattcattccataaaaattcttctatatcttcataacttgaaatctctcgatcaaaaacataagcaaaaaattgctgcaaattcggtatatcatattgtttaaaatccacaatatacagcatttcatatacttctttcttcaaaatccgtaaatctgaaataaagtaacaccgcataagttttacagcatcttcaaaaatatctttttgcataattaaccatcctttcaagtcatatatctatttcttctctttatcctaactccgcttgatttgtaatttcccattgaccttattaacttcaaaaataaacggatttttctggaaccagactaaatcagcagcctttaaattccactgttcataagcaataataaaagtttgataaaccagctcttcagcttctcttcgagtctctagagccgattcgaaatttgaatatgttcctaaatcaaaacgtttacctttaaaaccaatactagctcgatatttattatttttcagtttataaataccgcatgctccactagtattatttctttttaatttttgtgagttaataaactctatacatgtaccatcaaccaaatgaagattattataaacactttcagtaatctcttttttctacacccacaaccgacatactgcccgtgcattagcccagtttcactaacttctgtgttcttttttctgttggagaaattgccataagtcgccaaacttctgtccttttttagccttgtttttaggaatacagctacaattagtgattgtccctcgtttcagtttttttgtattaacaaatgttatttctccacactcacatctacattcccatactttatatcgagcttctaatttatttgtttcagccaagacgagtaatttaccgtattttctgccaactagacttttagtctttttcattaattgaatttactttaagcttagaagcagataaacaaatttataattgaacaacataactgtgtcctcatttattcgttcatccctcctcaataattctagtactaataatgtaaaattgtgtttatatttgtcttgcacatagtacaaattcgtccgcataaagtagactttatcgttcaacaaatgtataatgaaaattgacagatagtacatcaaaattaatcatagtagaaagaaatttgtgtgtttttatagttttttcgttaaaaataaagctttatcttttcgaatgaataagtctactattttcataataatcatcacttcaaatgaacccatcttaaaaatgtatcttgagaaacattaatagtagtggctgcttcccttgaggtgatttttttatttaaccatttttcctttaaatcataaaactcttctggaacaggaatgcacggtctaccaaattttacacctctttttttagcagcctcgattccttcacgctgtctttgcttgatactttgtcgctcggtttcggctacatatgaaagaatttgaagtactagatctgcaataaatgtccctgtaagattttcttttcttgttctagtatctagtagtggcatatctaaaacaacgatatctgcttttatttcttttgtaatgactcgccattgctctaagatttcttcgtagtttctacctagacggtcaatctctttaatcactaaaatatcttgctctttcaatattttaattaattcactgtacttgggtctatcaaaatccttaccgctaaacttatcaatataaatattttccttttttactggaaattgtgataaagcaataatttgccttgcttcattttggtcttttgaagaaactcttgcataaccataaatatttgtcataaactaaaacctcctaaatttatgcagtattataaaaatatctgcataaatattattaacaagttatgataaatctatattactgaatgtaaaaaaagttagtaataagtcgatgttactaactagctagaaatattattactttataaattgattttaatgaataaataatttattaaaatcaaaacaggaaatatcaagataggagaaaattatgactaaatcaaatacaattattgaattaaaaaacaaggtgtagttgcagtaattagaggaacaagttatgaagaaggtcaccaaacagccaccgcttgtattaaaggaaatttaaaagctattgagattgcttatactaacaataatgctgacatgattattaaacaattatcaagtgattatcaaaataataatactgttttaattggtgctggaactgttttagatgcaccaactgcaaaaaacgctattatggctggagctaaatatatagtatcaccagcttttaatcaagaaactgctataatttgtaatcgctatggtattccttatattcctggctgtatgaccattaaagaaatcattactgctatggaatatggctgtgaaattatcaaattatttccaggaagtgcttttggtcctaactatattaacgcaatcaaagggcccttaccgtatgtttccttaatggtaactggtggtgttaacctaaataatgcagctgagtggtttaatgctggtattgatgctattggcattggaggagagttaaacaaactggcagctaaaggtcaatttgaaacaatcaaagaaattgcacaaaaatatgtaaatactaaaactagaaaataattcttatatctcaataatataataaaaaactattatttaatattttgttataaaattagattataagagaactcccaatattactaataattcaaaataaaaatactttttgcggctatctaacactttgtgtaatcaaacttatcaattgcagaaataaaagatttctgcaataaattaaatactaatataaattaaggagtaatttctgaattgaatagaaactactccctttaatttgattgtaattatttaaatagtataatacttgacatagtcttatattcttatctataaaacactttttatgattttaaaaatatttttataaacgaattatttaaataatttttacatattaagatgcacccctttcatttgaatatacatgtccaagattccaagtatatatcaaactttggggtgcacttcattttaataagaactttttaactgcgagatacctataatcataaatattacatttcacaaaaactatattttttattataagttattagagactccttttttagctagtctattgctacacctgcgcttacataacctgcaacagtgttgactaaactcaatccagatgcccgtgcagttaaaacaagcattaatcttgttcccgccggaacattaatatttaagccagttaatattcccttagaaatcgttcctatagaaattacacctgttagtgaaggcgttaatgttacagttgttccaggcactacagtcatagtgttgtttggagcaattgattcatataattttgcttcaatcgtaattgtacttcccactaatgataatgctgctgttgttgaaaagaatacatcgattgaagtgatgactccatctcttggcattgtaaaagcaaagtttgttaacgtgccagatggattggttaaatcaattgtattaccaatgattgatattcctggtgctgagctaccaaaccctataaatgcaggggtacctactaaaccaccagcaatagttgttaaagatacaggtaaaccagatgcaaatggtattattgctgaagctccagctgctcctgttgatccagtcggtccggttgaccctgttgctccggttgctcctgttatcccagttggtcctgtcggtcctctatctccgtttgcaccatttgtaccagtcggtccggttgaccctgtcgctcctgttgatccagtcggtccggttggccctgttgctccatcttctcccgttgctccggttggtccggttggtcctgtcgctcccgttgctccagtcggtcctgtcggtcctgttgctccgtcttcccccgttgctccggtcggtccagttggtcctgtcgctcctgttgctccgtcttctcccgttgctccggtcggtccggttggccctgtcgctcctgttgctcctgtcggtcctgttgctcctgttgctccgtcttctcccgttgctccggtcggtccggttggtcctgttggtcctgttgctccgtcttctcctgttgctccggttgatcctgttggtcctgtcgctcctgttgctccgtcttctcccgttgctccggtcggtcctatcacgcctgttactccggttggtcctgtcgctcctgttgctccagtcggtcctatcacgcctgttactccggttggtcctgtcgctcctgttactccggttggccctgtcgctcctgttgctccggtcggtccggttggacatctaataataattggtggcctgcatcggcaacatggacaccatatacaaccattataattacagtctttcatcttatcacctcctttatgtgatctaatataatatacgcaaatattttaataactactgtgtcaataatctcataaaaaataaaagactaattttttcattaaacttctaaagtaattatctaaataaaaaagttactagatacatatgtaaatcgtatacccttaacgccttataaaaaataatagtttatcatattataataaaaggacttactcctttattaaggattagtcccttttaaatctttttttacttctattcatcattttcaatacgattaaaatacaatttattatgcaaatatgatggatcatttggtttacattttcctgccaattcattgtaatattttgctgttttataattacttagcttatcataacataaacataattgcatatagggaatataatcataacaatctggagatataaatgctccagatgtatcatcacgctcacacgataatgctactgcactccaatagatagattgctcatactgcttcaattcaaagaaatacttacctaaatcacagcatatctctgctcttggcaaatcatagcaaagactatttaaaagccaggttattgcttcttgcatatcaccaagattgtaaaaacaatagcctaaaaattgacaggcagaaatgttattttctttccatcccttcttggtatttaaaaatcttttaaattcagctactgcttcttgatacaattgatgataaaacagctcccgagcataatagaaaatttctcgtggactaaacattaccccttcattcaatttttctctaaatattcttaaattacgattaacatcactatttttcaccttactatgtgtaattgcaagatcactataaagcaccttacctctaggacttattacttcatgtataaatccttcccaataaaaattatcctttcttcttaataatctttcacgataatacgtaaatgtcggcttattattctgatcaaattctgcattatatttcatcataactacagaagtatcttttgataaagtttttttaagattaatcaaaccttcttgatcgctatctgaaataatatcatccgcgtctaaccacatgcagtaatccatagttgcctttgaaaatgaataattccttgctttagcaaaatcatcacaccatacaaaatcatatactttatcagtatatttcaatgctatctttttagttcgatcagtcgatccggtatccacaatgattatttcatctgcaatcctttcaaccgattttaaagctctctctaataccatttcctcatcttttacgatcatacacacactaatagttatcatatatttcaccactataatatatgtcaacaacccttaaaatgtgaaaatatttaaaacaaaaaatgttctaaataaagaacatttctaaataatcttagttgagcattcttctaaattaattacttcatcaacaattggtaaataaaattccggttcatgactaactaaaataacagctcctttaaaagccttgattgcgctttgtaaagaatctttagcatcaacgtccaaatgatttgtcggttcatctaacaccaaaacattagcttcacgattcataatcttacataatctaactttggcattttctccacccgataaaactttcattaaagattcaatatgatcagttgttaaaccacacttagctaacatagctctaatctcaccattgtttcgatctggaaattcctcccacaaatagtctaatgcagtttgggaaactgcagattcttcttgtttaaaaaaaccaatttcaacaaatggatctttttctactgttccactataaggtttttgcatcccaatcagcgtctttagtagagttgtctttcccaaaccattgacacctttaatagcaactttcttatttctttcaaaaacaagattcatttctttcgttaaaggactatcatatccaatcactaaatccttacaatcaaataatactttacctggtgttctagcttctataaaagaaaaagtcggttttattttttcctttggtttagaaataagattcatcttatctaatttcttttgtcgtgaactagccatattacgagtagctacccgtgctttattacgtgcgataaaatcttcaagatcagcaatttctttttgctgcttttgataatcagcagctaactgacgttttttcaattcaacttgttgtaaatagtagtcataatcacctttataacgagtcaatacaccatcttctaaatgataaataatattaataacttgatttaaaaaactaacatcatgactgactaaaataaaagcattatcataattctttaaaaaattgattaaccaattgatatgctgctcatctaaatagttagttggttcatcaagaattaaaatcattggattctctaataataatttagttagtaaaacttttgaacgttgcccaccagatagcgcatcaaccggtttatctaaaccaatatcattcaaccctagaccacctgcaacttctttgattttaacatcaattgtataaaacccgccatgatctaaaatttcttgaatttcaccaacttcttccatcaactgattcatcgtttcatcatcacaatcagccatttgttcatacatcgataacatctccgcttctagatcataataatatttaaaagcatcttgtaatgtttcatatatagtttttcctgggtgtaaagctgtgtgttggtctaaataacctgttgaaattcttttacaccattcaatctttcctgaatccggagcaatcttaccagtaataatatttaaaaaagtagatttcccctcaccattagcacctactaaaccgatatgttcgccatttaataatctaaaacttgcattttctaaaatagttcttccaccaaaatcatgactgacattttccacacttaatatactcattttctacctcaacttgcaatattaaaggaagattatcatcttcctaattcaactatattatacattaaaattactaactgtcgagtctaaacaatcactcaattgaaaagccatagtatccattctttccattctctttaacataatataaataataatctgcattattaattaattcctctttagataaacaattactaaaagaattataatatccagatgaaatagtgattttatcatacccatataactcaaatttactataaacttgttcaataaaactaattatcatttgctcattacaatctacacaaatacaaataaattcatcaccgccaaaacgacaagaaattattctatcatcatcttgttgtaaactatcagcaaaatcctttaatatttgatcaccagttaaatgacctaaactatcattgtattctttaaaatgatccaaatcaaaaataataattcctaatagtcgacttttatttttaaactcactatatttataatgaaaatatcgtcggttataaatcttagttaaatcatctagtctagactccttaacgatatcttttttttcttccattgctttaaatagttcaattttatataaaacactatttaaacaaaaatcaatactttctttttgattttcatgcatcaaataataatattgttcatataatttaggcaactgttctttttcttcaaaaacaatacaatactttatcttcatttctaacatttcaatttgataacgcattccagttttaccaaaatcattctcctttaataaaagataaagacattttgtccgctccttatccttgattgcaaaagtaatatacaataaaatatgatgaataaaataaattgcttcatttgcacgaaaaccatgaatctcattccctaatatattatcaataaactctaaagcttttgctacatcaccatgcccatagcaaattaatgcttttaatgcttgccataaccgatcaatcggatcaaatgaagtatcattaaataaatccttattttcttccattagagcaattgcttgatccaatcttcttttttcacaataaattataataagataacataacacaaaacgttttattttatattccggcagtttaggagaaatctttttgatctgttcaagcgattctaaaaaataaggtaacgctaaatcaaattgacctaaattaacaaaaacatctcctaaattacagttaaattttgctttcattatatagtcatttaactgctcagctaacttcaatcctttgagataaaaaccagtagcaagagaataatcattattacatactgcaatagcatataggttgtaagcctgcatcaataaatctggataccctttttcttcatttagagccaacatctcattcgctaatttaactgtttcttgttgcgatttacaagaataatagtaatcgattatgtaattactagctaaacataatatgtaatcatctttttgttctagtgctatttcttttaactgcaaacatttttgatacattttctcgatatcatcaaactgtaaatgacggatttcttcgactaaacgatctatctcacgcattaatttctcctttctttaagcactttgatttcattataacataagatagttctaatattggttaaaaaattcctagttttaactaggaatcgtatatctaattatttaaaaaatgttttataatcttcataattttttttcaacaattcaggtgtatttaatccatacggacaatgcgacatacatttgccacaattaatacaattttctatttttttcatttcttcttgccaatgttctgacaaccagcctgcactaggagctcgtcgtaacatcaaagacattcgagcacactgattaatttctattcccattggacatggcatacaatatccgcaaccccgacaaaattcaccagataactctttttgatcatgagcaattatcgctttgatttcttcactcataattggtggattatcattatactcaataaattcatctaactctgattctttttgaattccccaaatcggcaatgtattatcaaactgcgctaaatacgcatatgccgcatcagaacggtctattaaaccacctgacaaagccttcatacaaataaaaccaacatctttttctttacataaatcaactagttcctcttccttttttgaagccaaataactaaaaggaaattgtaaagtatcatataaaccacactcaacagcttctcttgctacatgtaaacgatgattggttaaaccaatatatctaatttttccttgtttcttagcctctagcatagcttcatataaacctgatccatcccctggcttaggacaaaacgacggattatgaaattgataaatatcaatgtaatctgtctttaataacgataaacttgtttctaaatccttccaaaaatccgttactgtcgttgccatcgtttttgttgaaatataaattttttggcgtacctcactaagagcctcaccaatcttttcttcactatcactataagcccgagcagaatcaaaaaaagtaattccattatcatatgctttctttaaaataacttttgcttcttccatatttactcgttgaacaggtaaagccccaaaaccatttcgattaacaacaatatttgttctccccaatcttactgtttccattttcatcctcctacaattcgacatttcctatttttattatactcccttgagtaaactttaagtcaagtaaaaaacgaaaggttttaacctttcgtttcatcaaaattatgattaataatttctaataatctgaactcattatcttcaaattcaaattttaaaatacaacaattcttcaagccgcctttttggtcaacttgactagtttcctgccaatatctcataaaaccacgacatgccccaccatgagaaactgcaagcacaactttatgatcttccttctgcataatttctaataatgtatcagcaattctttggcgcatctgtaattctccttcaccgccataattgacaaaaaaatcaccatatggcagcggcggatttaaatcttcactttcaccttcatatattccaaaattccattcctttagtcctttgactcggtgataaggtaaatcacagactaactctaaagtatcacacgcccgctcagaagttgaactataagcatgatcaaaaacgatgttattgtctttaaaatattttcctgctatcttagcttgtttaattcctaactctgtcaaaggggcatcacaccacccttgaatttttttacgagcattaaatagcgtttgcccgtgacgcattaaatatagagtcttcttcacccgatcagtctcctatttttactattttatttgtggaaaaaccacaaccaataacattttaaatgcttcttgaccatatacagaatgcggtttattagccggcataactaatgtttcaccacgctttaagacatattcttgaccatcaactgtaaactttccaacaccctctagcacggttaccatcgcatctccgctagagccatgcgttccaatttcttcacctttatcaaaagaaaaaatagtaatacttaaagcatcattttgtgctagtgtcttactaactacttgtcccgcttgaacttccacttgcgatgctaatgtagttatttgttcatggggaatatttttaataaatatatcgctcatatcttacctcctatcaatatttattcccaagatatgtttatattatagcataaaagttaaataaagcgattaacgatactgcttcactttaaaatgatagtttactatcttattaagataatctaaatcatttaaatcctgaataaatcttgtggttagctctaagtcaagataaaataaaaaagtgtaatctcgttttttatttatataaaaagcgaggattgatcattaataagaagttataataaagagggtaatataaatggaatggattgaacggctaaatacaacaattgaatatatcgaaaatcatttaacagaaaaaattgattatgagcagctcgctaaaatagctggctgccctagttatcactttcaaaaaactttcctttacatgactaatatctcattatcagaatatattcgcaaacgacgtatttctttagctgcagttgatttacaaacaggagaagacaaaatcattgatatagctttaaaatatggatatgaatcaccaaccgcattcaaccgtgctttccaagcagttcatggaattgcaccctcacttgttagaaagaaaaatgttcaaatcaagtcattcccagctctaaaatttaccttttcaattcaaggtcttgatgaattaagttttagaattgaaaaaaaggatagctttaaaatcctaggaatcagctctcttttaagtaaagaattactagaaaactttgtccaaatccctaagcaatgggacaaagcattaaatgatggaacccttaaccaactttatcgacttaataatcagactccgctaggattattaggagtcaatattcatcaacacgaagactggcgttatttcattgctgttagttcaactaatcataatcaaaattttgaagaatatcatatcggcagcgctacctgggccatcttttctggtcacggaacaaatagaactcttcaagagcttcagcgtcgtgttattacagagtggttgcctacttccggatatgaatatgctaatatcccagatatagaagtttatctaaaagccgatccaaatgatgccatttacgaatactggttaccaattataaaaaaataaggagttatgttatggtaattacaaatattaaggcctcttttcctaacgatataaaaactatttggaatattgttacttccctagataattatacttggcgcagtgatctttcaaaactggaaattatcaaatcacaagagcaatttatcgaatacactaaaaatggttatccaacaacttttacgattacctgttttagaccctaccagcgttatgaattcagtatggaaaacagtaatatgaaaggtcactggataggattattttcatctcacaatggtattacttcaattgattttacagaaaatatcacacctaaaaaattcttcatgaaaccctttgtcaaaagatatttaaaaaaacagcaagctgcttatattcgtgatttaacagctgtcttagaagcaatagaacatcgattttaataacaatcccaattatacaagacttttgagaaattcttattctctaagtctttttttgttataaagaaattacaaataccactatccccccacataatctctttatcaccaatacctacactatcaatttgtagtaataaaatataatcatcgtacttttcactactgcgggggtcttcttgagtaaatgcaggatatccaaacattttatgcccaaaaccgctaaattcattaaattcatcctcatacaaaatttcatctggtaaatcataatatgatgaaattaaattatttgggtataagttattccattcttgtgtaaataaaccatcaaaatgataatcaccaatacttattccttcttcgccaccaataaaatgcagcttaaagttatcaactattggaaaataaccctcaccttcaggatgatatttattaagtatctgactttcagatacagttttatcaatacttgaataataaataacccgactttctgcttgcgatatcatattctcaaaatctaaaccataaagatcattatccatagcccaaaattgcaataaccctgcttctaattgataactattcatcggtaaatcagcaaaattaatttgccccagcaatcgcaattgtttattatctgtacttaatggtgcttcgtcatctactcctaagtatggtaatcccccaaatttactatcaaaaatactacactcatcattacttaattcaattttaataacatctctttgagtatagtctgtaatcaccttcatcgtacttaaaaacatttctttattcatttctagttttcctgactcttcgactggatcttttttctttttaaaaaaatcaaacactcatcatcactcctttcactaaaacataaaacagcagcttccattatcatttctttatttaattttagcaccttcttaaaaacaagcaaacaaaaaacatctcgataatttataatccgattaccgaaatgctttttaaatatctaaaaattataattttaaatcatgcatggcaattacttcgaccaataaagcaataccaccaacaagtaaataagcagctacaatataatttaatacgacggttgacatcaatggcgcaataataaatgctaaagctgctaaaacattgattatacccgtaaatataacccaaccataactttcaattccaaaaaagcttaattgatgagcaaaactcaacttattaagcccataaaccattaaaataaatccaaaaataaaagcaaatgtattaattgtcatttcaattggtgaacatatcaacaaaagaccaattaataaattacaaatagcgcttacaaggccacctggaccacgaaataatggtggtgccgctatataatcaatgatctgataaattcctaaaataagaattaacccggttgcaatcgtaccaattatagtaactgattttactggataaatcatgcatagaatagcacaaataatcattaaaatagcaacaataattcctgctactcttaatgagtgaatctttttattccactttccaacaaattcacttcgaaaatcaaaatcatcattaaatcttaacatctctatcaccttctatacttatattatagtcttcaaaaaataaaataatataaacaaatttgtccttttgtctaaaaaatcctatactataattggtttattatgttcagatacggtatattaagcactgcttcaatcattgatcgttttattgcagggattagagaaagccaagatagctatgttcaagcaattgcatcaagaaatttagaaactgccaaaaaagcagcaaaacgattaaacattgaaaattattatggcagttatggtgaattgctttgtgcaaataatattgatattgtttatattcctacagttaacagtcaacactatgaaaactgcaaaaaagctctaaaacaccataaacatgttattgtagaaaaaccttttgctttaactgtcttagaagctaaagaattattcacattagctaaaaaaataattgttttttaatggaagcacaaaaggctctctatcttcccacaacaagtaaagttaaagaattaatcaatagtgagataatcggaaaaattaaatacttagaatttaaggctgggtttccaggtcgctttacttacgatcactggatgtatgatctatcattaggtggtggtgctctttatggaagtgctacttatacaattgaatatctccaatatctttttgatcatccaaatttaacaattgatggtacatgtatcaagtgctctactggagcagatgaaatatgtaatttccaattgaagataaataatagtattcttgcttcttcaacaatcgctatgaatgtggcattaaaaaatgaagctgttttttatggagaactaggttatatcgttgttcctaattattggaaatctaatcagttagatctttatctcgatgatggcagtcatagtcattatgattttccttatcaaagtgaatttgtttatgaaattgaacatattcatcaatgtattaataatggtcgattagaaagtcctatcatgaataaagaaaaaactattgaaacaattaaacttgttgaacagttatatcaaaaatggaaataaaagaatctttgccataataaaatgaacctccattacttgtaatgtgtaccctccttactgatttgttcagtaaagagggtacacatcattgggtgtccaaataatggaagttcatttcaaattagaactaaaactttttattattagtaacagtggcataaaaagccacccccaaaataatcactcctccaagcagttcctttactccaggaatctcatgtaacaaaaatatcgcaaaaataatgctatacacactctccattcccgatattatccctgcagtttgcacctttactttctttaaactactgacataaatgctatgagcaacagccgtacatataactcctagaaaaataagcgcaaataaatcaagttttgttattgaagctttaactatcagcaatgacggtaataatataatcgcagcaattccttgttcatataagcaaatcgttctccctgtatatttacctgcaaaatagcgattcatcaagcataacaccgcataacttaaagatccgattaatccaataaagattcccagtgttatttgattgttaagtgagaactctggaattgtaattattaccccagcaaacattgttagcgcaatcattatattttttattctaagctcttcatgatatactagcggttctaaaaaagtcacaaaaagtggaaaagttgaaaaagtaattgttccaattgcaacagttgataattgaattgcttgtaaaaaagtgaaccagtgaagtgccataacaataccagcagcgatgattagaatataatcttttttattactcaatctaactttctctttttttattaaaattattattaatagaaaaattgaagaaaaagatactcgtccaaaggtaatcaaaatagctggtagtgtgacaaattttccaattactccggctaagccaaataacataacagccaaatgtaataatccaacttcttttttcatcactttcccctcctatttatagttaataatagtttagctcatttttaacaagaaaaaaagataaaccacctatatcatcgctgtccattttctaaactaaaatgcaaggccaataactacttaaaaaccttcattataattagttattaataaaatatttaattcgttcaatcgttgactgagtttcaagatattcaggatacagaacttcaaaaacatgtcctaaatgttttccttagagcaacacacggttcaaacataccagttataagccttcaatacatttttagcctttattgactaaaaatgtaagttatctcactactaataatacgtgttgaaagtggcggtaactatcaattacatcaataaggcaagcttttcgatatatgtctgaatcttcattgttaactccctgaaccataacactaacctactgataaacaaaatttttactgttagtcaaaacttattaaatcatctccaccatgtaacaaaactctctaatcataatttctggtggctgaacattatatactttacagagctcaggctgttttatgattgcataaaccaatcctgctaaatgcccaccagctgaatcactcagtaaaaataatttgatcaatattccaaaaatatttattctttgttttagcaacaaactttaaagtcataataatttcctgaacttactgcttcaacgaggcttgtggtattagagtataatttatattcacaacagtaaaatttttagcagctagcataactgcaaatttttatttactcctttatcaccataaatccaggcatcaccgtgaacatcaatgatcatagacaatggcttagtcgtggattaaggataataaatatctagtaaatgattatgattcctgtcatcttgataaggaatatcaactacttagtggacattttcgagaatagtaaaaatatcattactttttggttgcattttaaaacgagcaaacttaataattgatggataaaatagatttatacctatcatctcctcattgaattattaataccacactattatgatactctttagccccattttctctatattatcgtaaaaaaagcatcatttttaaaatgataccttttaaataacatataaaattatacataagaaatgtaacacacttcctaataagatccataaatgccaaatactatgcatatagcgatacttattttgcaaaccataaaaaacggtaccaatcgtataagctacaccaccagccacaagtaaccaaattccattatatccaatagcttccggcaatagattgaatttaaagataatacaccagcccatcgctaaataacaaatcattgaaaacttttcattactttcaatatcaattgcatttaaaatgattcctagaaccgtacagccccaaacaacagcaaagatcatccaagcccaaaatgaatctactggtcttatcgaacacaacacaataggtgtataagtaccagcaatcaatacaaaaattgaacagtgatccataatttgaaacacttttttactcttagtatttggggaaagcccatgataaatactactcattgtatatagcaagatcattgatattccataaataattcctgaagctataccataattgttatggcgcaatactccaaaaacaatacaaagtactaatacggcaattccaaaaactccacctacaatatgagtaaccatattaaaaatttcttcacctcgagtatattcgggtaatactcgatcatctaattttgttcgtttcattgaatacccccaatctatatgtatgaatatagccctatttcatgttaatttcaagaacatcatataataacttcttataaatttctttgataaaaccaaacttagtcacagtatttgcctgtcgattgcaaaaatattgttttgctaaaaatctttaattatccatttttagcttactgctataaaatatttagatatttaacaaattacactaaataatcatattttctaactttattatgacaatgtatacagctaaaagatatgtgttccctccccgcaaaataaataataattaaaattaccatgctggattccacaatagcgataaccagctttttgtatttgtttaaacagtttgatttattttcatccttcaacaaatagttttcaataaaatcatttaaatttctatgataagcactaatataaaagttcccctatttttattccatatcccagtcttgtcctcaaatatataactgttttgaagattttctactattttaatttctttattaaaattatttatactgtaactctcttttaaattttctaatttgactaataaatagatcattattttgtaaagaaatataaaaatctttttgctctgtaacaatattgagccgatccaaagaattagctgatgatgcaattgcatcacgacttttctctattcttataatttgttgataataaattccaaaatcttcagtaatccccctttccttttaatcctgattaaaatagtctttaaacaatttaatttattataacaccctaattagctgattcatcatttctatcacttaacgattcttcatcataaaaatatatcttaaaaagaccatttgactcaaattctcatttttcaaattactcctttatcgatataagtatatattgctaatcataacaaaacaaagatattctaattttgtaagtaaaattaccttgcttgattactttaccatccttagttaattctaaaacaaagacaatcactatccatatcctcaatctaattatattatctcataatcaataatctatcacgaattaaaagatgcctaacggcatcttaaactgctaaatcaaattatctagtcttttccatcaaataattagttaaataaacattatctactttgactgactgttctttaataactttatatcctcttttttcaaaaaaaggcttagcacttatggaagcatgaactgttaaactttttacatctttacaatactgttctaacttatcacatagctttgttgcaatctgttttccttgataatctttatgtacgtataaatgatctaaataacctctcttatcaatattaccataacccaaaaccttttcattttcaacagctacaagagtatacatagagttaaaaaagtcatcttgagtcagcagaaaattactccgatttgaccatactttgatttgatcattattgtaatcatatctatttattgtattaatcgtttcataaaacaattcacaaattacttttaaatccgaagactgatattttctaatttccatcgatttcaccattaataattttataaactctcttttttacttcacctaaatcttccttacgtaataaagggagagatcacatagtttttcttattcataatcttatcattttaaccatcccaacaattcgatcatttcattaccaaaacattcttgtctaaaatgagccgaattctctccaataacagaatatgctgaaatatctttcattacaactgaatgaattacaataatccttccatcatcattttggcgcataatcatatttaaaattaccattaaatatttatatagtaaactgcaattatatcattccttttacttctttaattaaattaaaattccattacaatgatctatttcatgttgaatgatctgagctgtataattactaaaagtttttattttctttttgaaatcaacatcataatatgctacttttatcttttcgtatcgctttgtctttttcactccaatatgtgatagacatccttcttctgtttcatataaacgtcccatagtttttataatttctggatttaacattactaaataattaccatcatcgtttacaatgataatatttttattgataccaatcatattagctgccattcctacacaacctgtagcatgagctataatcgtatctaataaatcttgaacaaccggtaaatcctctttagtagctggaagtgatttttgacttagtctaaattgatcactaactatttctcttatcatttattttcccctttatattgtcttagcaaagcttgatgtttctttaataatgaagctgaatatactttctttcctggctgatctctaataaccttccacaatatcgaggcagctttcaatttattataataaattttattattttcatcacgacaaaaatcttttaaaaactgattccactgacaagctgaattatcatatttagcataatcactttttccataatacacatctaaaagatccttgagcgtgaaattaacattcccctcacttcgaacccttctcaatgcagttgccatatctgcggtgaacttaaaattaggtgtttttgtaatttcgccaaagaattcacgaaaacgtccattaagaacaaagccacattctaataattttgtttctaaggttaaaggcacatcttgcttccttattttcattcgttttactggtttaattatttcaccattaaaataggctttaatattatcattcagttccgttttagtacctgtatgagtaattccgtgttctttacaaatttgttttagttcatcacgataccaataatactgtttaaattcatcaaaactttgaatatcattaaaatttggacgtgtcatttatattctccacccctgtcttttaatatcatatcatctatagctacttatctcaataaaaccatatatcatctttatatagttcaccccttagttggaaatccaactaagaggttcaatttcattattattaaaaatcatttagataaacagattagcacacatagtgaagatagaacagattatgattccggttacagctggaactaagaaagatacaatcgcccatttccaactattagcttctttttttattgttaaaagtgttgtcgaacaaggccagtgcattaatgaaaataacattacattaattgcagtgatccacgtccagccattttctactaataaactttttaacattactaaattatccatttcaatcaaactaccactagcgaggtatgccataatcatgataggaattactatttcgttagcgggaaaccctaaaataaatgctaacaaaataacgccatctagaccaatgcatttagcaaagggatccagaaaattagaagtaatatttaaaattgtcataccatcaacactaatgtttgccattaaccaaataataagaccagcaggagcagctactgccacagctcgagataaaacaaataatgttcggtcaaaaattgatctaacaatcactttgccaacttgaggtttacgatatggtggtaattctaaagtaaatgaagatgggactccctttaatatagttttagataataactttgaaataatcaaagtcatagttattcctaaaacaattaacattgttaaaaatattgctgataatagagaattttgcatagttgcttcggttccaataaagaacattgttaagattgctatcaaggttggaaaacgaccattacatggcacaaaattattagtaatcattgcaattaatctctctcgtggtgaatcaataatccgacatcctactattccagcagcattacatccaaatcccatacacatcgttaaagcttgtttaccacaagcgctgcattttttaaatgcatgatcaagattaaaagcaattcttggtaaatagcctaaatcttccatcaaagtaaacaatggaaaaaagattgccattggtggcagcataacacttacaacccaagctaacaccctatataccccagatacaagcatatcactaagccataacggcgtcccaataaaatgaaagaactgattaaaaggtacttctaatccaaataagaaatccgataaccactgcgatggatagtttgcccctgttatagttatccaaaatattaaagcaagtaataaaatcatgattggataccccgtccagcgatttgttaaaatcttgtctatctgacgatccctttgattataatcttgcttttgatagtgaaccactttttgacaaatcaaatgagcactgtgaataaatgaaacaacaatcttgtcttgtaaattatccttatttatatcatgttgtgctaataattcatttgcttggtcgatagcttctttaagctcttgatcatcgtagtccagtcctaattgatttgacatttcaatcattaaggaaggatcgttttcaatcaatcttaagctaagccactgataacttaaagaagtagttactttcttttgcaatacttcctcaacaattcttattgcttgtaataaaatatcactataagctatttttaaggatttgtaattaactggtctatcgattgcttgatctaaagaatcaataactttatgcaaatctgtcttttttctggcagtaatcccaattacaggaactcccaagcaagatgataattgctcaagatcaatatcaattccttttttcttagcttcatctaacaaattaacacaaactattacatttgtatgaatttcaattgtctgaattactaaatttaagttacgttctaaacaagttgcatcacatacaacaacaattatatctggatgctcaaagcaaataaaattacgtgctacttcttcttccgctgaatgtgctaataatgaatatgtcccaggaatatctactaaaacatatgaattttcttttcctcgacaatagccttgagcattagtaactgttttaccaggccagttaccagtatgttgatgaaggcctgttagcccattgaaaacagtgctttttccaacgttaggattacctgcaatggcaacaactttatcatttctactttgtttttttattactaactttgtctcacttgcattaattcctgtagatttgttagttaagcccataattcacatcatcttttctaattaaaacattttgacaatcttcattccgtaaagcaattactgcacccctgatcaaaaaagctttaggatcttgacttggactattcaaaatacattgtacttccgtatcatcaactaagccaatatctaaaagtcttcttttaatactcccttgtgccattaatgaagtaatcactcctacttcacccatttgtaaatcatttaaacatctattttctatcataataaatttctcctcatcgtatattagattaaggaaactttgtttcctaatactataatattaaattactagtaaagcgttactaaaaaggagaaaaaaatgaataacgatgaaaatgcctattttactttcaagggctatcaattgaataatgacagtaacttaacttcttcaatggaagattatttagaaatgatcattcgcttaaaagaaaaacaacccttcgttagaatcaacgaattggccaataatcttaatgttagaccctcatccgcctctaaaatggtaactaaattaagtcaagaaggctttttagaatatcaaaaatatggaattatcacgttaactgaattaggtaaacaatggggtgaatattttatatatcgtcatcaggtattaaataactttctctgtctactcaataacagtcataacgaactagaacaagttgagaaaattgaacactttcttaataaaaaaacaattgataatttggccttgcttactaaagaacttcacaatctacaataaaaacaacaatatgggaacaaatccattaccatactgtcgtcttactttttatcgaataaaattagtgaatttatgctcctctttttccggtaatccaaattcctttttacctaattgaatacttttaattaaaaaagccatattcttaccaagagttctcatcgtttgtagtccttcaaggtcctgctgtacttcttctggtgaattaccatgtaccatattccaatattggctagaggctatcggcatttgagaaatagtaaaatatttatttaattcatcaaatgtagcactattaccccctcgacgacaactaactacagccgccccaactttcattgttttatcagcagtcatactataaaataaccgatcaataaatgatactaaggttccatttgccgacgcaaaataaactggtgaaccaataacaatgccatcacattctttaaattttggtgcaatatcattaacaatatcattaaatacacatttccctttcgtcttacattgacgacaaccgatacatccacgaatatctttatgaccaacatgaataatctcagtttcaatcccttcactctttaaggtttttgatacttcctctaaggctgtatacgtacatcctttagcatttggacttccattaattaaaataactttcatttttctatcctccttgatttctctttttatttatcttacaattatattgtaatactcggtagttactaccggtcaataattttttaaaataaatcaaaaataggggtatttattatgtgtacgatgaaagaagtatgtaaagaaattggtatgaattatgaaacattaaagttttattgtaaagaaggtcttgttcctaatgtaaaacgagataaaaataattatcgtaattttgatgagaaaaatattgcctggttaaaaggaattcaatgtttaagaaaatgtggattaggcgtaagtgaaataaaaatatatatgaattattgtttacaagggccaacttcaattccccaacgtaaagatatgcttagccaaacaaaagaacatttgttaaaaagaattgcagaaataaatgagtgtattgaatatatcgataataaacaaagcttttacgatgacgtacttgaaggaaaatgcaggtacacaagtaatcttattgaaataaatgagtaaatagctttgataattaccactttaagaaaataagtctttatcttttgtcactaaaagataaagacttatttctatattagaaatatcctactcttcttcaataaaatcaacacataattttgtaattccgcttaacatataagagctggcttctttaatataataaaattcaggtaaaaattctttatcaataaaagaggatagcacattttttacttcatccatatccggtgtcattggtgaacttatcactacagcttcgggtccaatgagcgaaatagttggaagtaacgattttgttacgagctctacggctccatgctgtgtccaagccagtttatgaacatcatcagataattgcatccgtcggataaaatatcttatctcacctgctataccatttttccctctaattactttaccattagaaattattccttgtccccctaccccaaatccaaatggctgtgaatggaaaataatattatcatactctggatgttctaaagaaaaacctacaactgctgcatttgcattattataaacaaaaacatcaattccatatttatcttcaaaatcagcttttatatcaatagttcttccatctgttggttctttcaactgcttttcatctttaacaatacccggtgtcgcaattccaatcatatcaatgtaagaatgttttaataaaatggtatcaataatatcgtagagatcgtatatattcattgtaggtttaatgacaaggttactatcaattatttcacatttatcatttaaccgataataaatacgtgtctgctctctactaatcaaaataacaattgataagatacgattttcatattctgcacaatgggtacattcatgcgcttgctcattacttttttcttggcggaaaatctcaagctcactttgaataaactttaaagcagctaaagcatcatacgaagcaaataccgatgttggtatttgtaataccggcttttctgtgatactctcttttaaacgtttgagcatatacccaatttgtggtgcaattaaaattacatcatacttttctgcttcttcataaatactcatataagatactgcatcaaaatggtaatctaaccctaacattcctgctacagaatttaaattatcagcaaacatagaagttgtaagtcctgccgaacatgataataaaacacgcaaagttttttcttcttttaacccaatcaatgtttcaaccatctcatcatataattgctttgcatgattttcatcattgagttcaaaatgaagatagaatttaacagaatgatccttatttgaaacaatactaaattcaacgattgtatattcctcaattactgtaaattgaatcgatgcctcaccgtattcagttactaatttaataagatcatcgttttctaaacgaatctcatatggagtattatgatgctctcgaatccaacctttaaaatcaaaaaccgcctttttttcagtcattttatccctcttttctctttataattttattttaacatccataataatgaacatcaaataacattatctttatgaccaaataaaaagacgatacaatattaattaacttaattgtaaagtcttttttattcaacatatttacgattgtctttgccaaaagtaaatggcatcatctatccaaccttcagctattgttcctgtgcctaagccaaatccatgtgatagacccttataacaatgaaactcagttggaatatttaatttatttaagtgctctaaccgttttttcataagaatatgatctgcaatataatcgtttgttccaatacatgcataagttggagcatcttcatttgaaacataatcataccctgtatactgcataatgacagcttcggctgaagggacagcaatttcactatatgaagataaaaactttttatttcccaatactgctgccattctagcaccagctgacccaccccaaagtgaatagtgtcttttatctattttcagcatattcgcattattatatataaacgaaatagccttagctaaatcttcatacggatgctcaacacgataaatcaaagcaaaagcattgtacccacgcttacttaactctaaagcatgtggaaaactatcatgcattgctcctacatatacaaaaccaccaccagcattgcatattgcaaaaggcgtatctttacttcctttaaaaaagaacaatcctacatctctttttgaagcatcatttaataattcttctttagaataaatgttataaaatattgaatgattttgagcatcgtgattgagtgtatttataatctcaattgtcttattcacatctatataattataccataaataaattttagacgaacttaattctttaatcgtcatatttagagctatcggtctattgattggaaatagtaactttccccatgttttaaaggctggaagttctaatacttcttgaatagtagtattttcacttatattcatttttaatgtccgccgaagacatcaaaatcaattgtatctaataaagcatcaatttctttgatttcatcaattgtaacttcaatttcccctgctctaaaattttcttctaaacgttctaattttctgcttcccgggataggcacaataaaatccttttttcttagcatccatgctattgaaagttgagccatagtacaatttttcttttctgataatacttttaacaaattcaataatttttttgctttttcatacccttctttttgatattgaggcatattatttctaaaatcccctttttcaaaggtagaatctggtgtaaatttccctgaaagtaatccattagccattggagaaaaagctacataagttattcctaactctttacaaacaacgaataaatcttcataccatctagccatcattgaatatctattttgaatagctgtaactgggcaaacagcatgtgctcttcttaaatattcttctgttgtctccgaaattccccatgctttaattttacccgctgcaatcaattccttcataactccagccactacttcaggttcaactttaggatctatcctatgttgataatataaatcaatataatcagtctgtaatttctttaatgatccttctatcgatgcatatattttttctggtgaggaatctaattctaaatgatcccctttatgttcaactccaaatttagttgcaataacaacctgttctcttacctcctttaatgcttcacctacaagctcttcattataagaaatagttccatcagtattctcaccagtataacattcagccgtatcaaaaaaattataacccattttataagcctgcttaatagtttgaattgctccctctttatcttcagctaagccataagcatgagaaaatcccatacagcctaatcctatcggactgacatacatattcgttttccctaactgtctttttatcatcatagcattatcctttcttattcagtaatcatcccacgataattcattccatataaatttgcaaaacgctgcattgtatattctcctgcttctaattgttgtttcgttggagcataaccttggaagataaaatacatgtttttaccctttaataaactttcatcaacatgttgataaaaccggtctaatagattacgaacagctccagacatactatgccaataaagcggtgagccaattacaattgtatcagctttactcatcgctaaaacaacttcatcaaattgatcatctgtaaaatgctgaccataactataaatcttataatctactaaatgcaatgtctgataatttttaccctttagaaattgctcacttaaagcaaccgtattaccatttttattaggacttccgttaataaataatatactcatttttttcactcctttaataatctattttttattcatggattttcctatgaacaaccatccttacaaaatcaggttcaaagtgtttagcccgtgaaccactatatcccatatctaaggatgaaatttttttcatctcatccttattcaactcaaaatcaaatacattaatattttcaataattctctctatatgagttgatttagggattacaacaacatctctttgaatattccaccgaagtaatacttgacccactgtcttatgatatttttcagcaattccttttaacatctcatcttcaaaaggattatatctaccgcctcctaatggtgcccatgcttcaggaacaacatcataatatttcattgtctctattgcttgctcctgagtaaaatatggatgcagttctatctggttaaccattggcttaatttctacaatttcacaaaaattcgttaatatatttggatagaaattagaaacacctatagctcttaactttcctttatgatatgcatcttccatagcccgccatgcagcaaagtaatctcccattgcttgatgaagtaaatataaatcaaaatattccaatccactttttttcaatgaattttcaattccctgttttgctgtttcatatgttcgcatatcttgcacccataattttgatgtaataaacagctcttctctcgtacagattcccgcttcaatagcttgcttaacagcatttcctacagcatcttcattcatataagaagctgctgtatcaattaatcgataccccgctttaattgcttgaaatacagtttcttgacattcttttttatccggtacttgaaatacccctaaacctaaaattggcatttctatttgattatttaaaataatatattccataatcttatcccccttattattcctcaccgtcaacatctggaattgttgttgccagtatatgctgtgatttttcagttatttgataaaatggacaatgtttatttagttttgctatttcatacatttcttcatttgttagtacaaaatcaaataactcgatattttctaaaatgtgattagcacttctacttcccggtactgcactaaaccccatttgcgtgtgccatttcaaaataatttgagacgttgtcttatgatatttaattgctaatgctttaaataacggttcatttaacaattcattactaccatgccctaaaggataccatgattgtagaataatcccattttcaaaacaaaaatcttttaccttttcagccggataataaggatgacattcaatttgcattactactggtttaatttcacaaatatccaaaatttcttgaatttgttcaaccttaaaattagataaccctagtgctttgattttcccctccttataagctttttccatcatttgataacccgcaatataattatttaaagggtgatgcaacagcatcagatcaatatattcaactcccaaccgttctaatgtttgctcaacagcattacttttttcataaaacgtcggagctaattttgtctcaataaaaatttcttttctatccaatccacttttactaatacctctacctacacttttttcattagtatagcgattagctgtatcgatcaaacgatacccattttgtaaagcaaaagaaacattatcttctacttgtttaccaaactgtccaattgttccaaaaccaatgatcggcatcttcacaccattactcaattcaattattctcattaatattttacctcctagtatattgtagattctgactagttcactataaagctatctagctttcatcttgctttaataatttatctttttaaaccacagatcatctcaacagttgctggatcatagtgagagaaaaatgaactcgtatctttattcatatttgtaatagttttcatatcttcttcacttaattgaaaatcaaaaatatcaatattttctaacattctttcttttctcaccgttttagctaatggcacaattcctctttggactaaccatcttaaaattacttgacctactgatttgttatatttttcaccaatttccattaatgtttcattagtgaagattcccttctttccctctgcaaacggtgcccatgcttctaattgaacaccatatttttgattatattctaatgcttgattctgttgatgaaatagatttacttccacctgattcactgcaggaacaacatctgtatctaaacataaatctactaaacggtccggataaaaattagatacaccaaccgctttaatttttccttctttgtataaatcaactaaagcccgataagcaccatgataatctttaaaaggctgatgcaataatactaggtcaatataatcgagtttcatcttttctaaagattcctccaccgatgccttagctttttcatagccatagtttgtaatccagacttttgttgtaacaaacaactcttctcgaggtacattagtttttaagattgcttctcctacagcttcttcattaccataagactgtgctgtatcaattaaacgatacccagtttcaattgcctccaggacaacccttacacattcttctttatccttgatttggaaaactccaaatcctgccatgggcatttttacaccattatttaaagttatatattccattatttttccccctattctagccatatatttttagtctcaataatcttgttttaataatttgatttttaaattcaagattcaatcataatcttttacatttaaatatatttagtttatatactaaaaatctttatctgattaacagtgcactataaattatgcacttgtatcgataagaataaaaagttaaatatggttttttaaataattaaaatttccatctcaccttatttatctttaaacatagtataaatcttagagttaactataagtcaataaaaacttaatgttattaatttaaaatatcactaaataaaaaaagaggtctctttcaaacctcctatccaatcataaaactatttttaataaacaaatctataacccaactataaaatatattactcgactgcacatatacatttatttttattagtatttttagctttatataaggcttgatccgcctgctctaaaactgcttgccaactttcttctccatttaaaacacctattgccccaccaatacttacagttaaatattcacgacttgaagtatttggcattaataaatgcagacgttcaacagtatgacaaagttctgtaccaattctttgcatttcttctaaatctgtattttttaataaataaacaaattcttctccaccataacgaatcaaaaacccttcactcaaacataaatttaaagcattagaaactctctttagacattcatcacctttaatgtgcccaaaagtatcattataagatttaaaatcatcgatatcaattataaaaacacctgttttaagctgactatcgcgactctctaaataaatattatttaaacaattagctaaataacgtcgattttgaagccccgttaaagaatcatgatgggcaataaaatctaattccgcacttttttcttcaatcatcctatttttttctagaataatactctgatttaaaaaagtttgtcgcattgattgataatgataatatccaacaaatagagccataatcgttaaccaggtactattaacataaatactataatgactccccaatggttcaccatgtttcactaattcaattccagtaatcaaaataatatcagagaacaaatacagaggaacaaataattttggcggtaaataaacaagaatagcaatactcaacattgtaataatatgcacactaatgttattagaaacacgattatcatatatcgttactgctagcgaccacatgattaaaaaaacaatatagtaattttgaactttcaacaataaaccctttttaacattctttttatgcaataaaatcaaccctaagacacagatgataaacatgagtgtgtataaaagcatataaatcttacttgacttggtataataggtaaaatccgtataaacacttacatagaccatattatagatttgaaataacataataaaaaatatcgggatcctaaaatacttcttaatatcatcttcgagaacatcaataaattcaagttcttgctgtttagttagctttatcttttcagttaatgacaacaacttcataatttgtcctttctaaatatctatttataattcttattgacgatgtaagaacaaaattggaaatggattcccttgttcatctaattcacttcgccgataaatagtaaaccccatatattcataaaaagctagagcttgaggattttgctcatttacacagacttcagtgatctcataatcatttattcctatctctaataaattcctaccaataccttgtcctcgacgttgtgctgtaataaataacatctctaatttatcctcagcaatccccataaaagccaatgtttctttattatcaacagcaactactaaaattggaatttcttcaattgcttgaaaaacatacttttttatttctcgaatattagtttcactaaaaaaatcatgagttgctctaatcgaactttcccaaacagtaacaagtgaactaattaactgttcgtctcgttcaaatactctttttatttccattagctcctcctttattactcaaagaaatcctttaaataaatatactgcattataaattttttaaacacccatagcaactacacgtttaatatattttttcataatcttttcaattccaacatttgttaaaatgatttatcattatttctttcaatatataaatagttattatttactttattttactataatcacataaaaaagatagttatttaatcaataactatcttttttcattaagttatcatttgtattttttgatttacctcttattaatataagtgcaataatatttgcagtcaacatcgtaattacatatattgtaagaattgtaaacattgacggtactacatccaataatgctgaccaatcttcatgctttacccaattacttactaattgataccctgctaaaagagtaagcacggtaaaaacaagtcctaaaatcgaaaaccaataagccctcagcttctcttgacttttaaatatagacagacagctcatcaaagtacagataatactcaagcttccaaagataatccacatactacattattctcctagatataaaatttaagattattttaaataagctcttgatcaataaactctatataatttttcttaacaacttcatctggatgatcaaggtaccactgatatgattcctctaatccttcgaaaagacttttttgacttggcaacagctgattttgcttagttacatcaagaacataattatagttatgaaaactaaaataatcacgttgattatcatgcttagttacatatactttatttagcggtactcctacaacttgataacataactcaacaaatttatttatatcaacaatttcgctatttccaacattcatgatatgatcatgagggtgctttttaataatggtttccattaacttgcatagatcttcaacatgaaaaaactgtaataacattttaccatcattaggtaaatagaaagaacgtttctttaatgcacattcaaacacaaaaggttcgcgataaacattttgcattggtccatataaatatggtggccttaaaatatatgcttgaggaatatgacttagtaaatagttttcagcttcaattttattacttccataatctccccagatagaatttcttccaaccttctgctcctctttgaacggttgtgataaactttccggataaacagcactggaactaatcaaaatataatctttgaccccatttagaccttctaacaaatctttgacatcttgtttagtataagcagtaacatcaaaaaccacatcaaaatcatatccctttaacaaatttcctaaatgatgtcgatcacctttaattaattttactccttcaatctgttttcgatttccacgattcaaaacataaacatcataatcatgatttttaaaataagttgcaacaaatttacttacaaaaactgttcctccagttaccaaaatcttttttgtcatattctctccttactttataatgatttagcacatgcaattaaataatgacgagcattagcagatgtcacttgtttagcccgcatcaataaggctcgttttttcagttctataatttgtaatgaattatcttgcaccatcaataactcaattaattgcaatgccatttgataatcttcttgtgccatataatttttaatagctgatattagtttatcattatcaccaattaaagcaagtaccgcctgattataagcctcagttggatgtggcaataacttcacaggatccccatcaaaccatcctacataaccattataaatacttttcactgaccattctacagtaccataatactcacctaaatattctttatcctgatatattggtgctaatttaacatttttaacagtttcttccaaagacattccctgattcatacaatctaatgttttaaataaaatatcctcgatggcattcctaaaagttcccactattgctttaatctcattttgccataaaactcgtgtatgtcctggtaataatgcaacagctggataatttaaaatctcatttaaagtatcaatccatgtcgcaacatcgcgatacatggttcctcttattgcataaagattaggccagcatccataataattatctccacaacacattatctgatcatcttctaaccaaacatagatttcatcatctgcttcacctacagcactaaccatctttaatttaattccatcaattactcgttcaaccactttttgctcataatatgtcgtcggttttataaaatcatattttccttctttaatttcttttccttcacggattccaattccttgactaatcgcttcctgatctgttaatccataaccatgctgataaatccctcgttgatttagtagtttactaattctatcgtagtattttaaaattggttttcgaggtttaaatgctattacttctacaactgtatcccgaaaagtacctgctcctcctaaatgatcaggatgtccatgagtataaataattgttttaaccggtttatcactaattttcgctagttcatctttcatcacttttgcacgataatcagaatcaagagtatcaattaatataattgaagtttccccaataatcgcaattgcattactatgtccatagcccaaaaaatgatatacccgttcattaactttagtaattttcttttgatagtttgttttcgtaaaattaattaacttttcttcacctaacattgcttattcctccttatatatcattatattgattatctagtcttttaatagtaggcacctttaggtaactgtcaaaaccgtagtcatttggactacggttttatttaatcatctaaaataaatgactttacttgattcttttttagtttattattagtcttaactatctcttcttttaaatcaacaaaatctttaagatcatgatttaaagaaattaaaacctctttattattagtattaaaagttcgataaattaatttatttgaagattctgccttttttaaaacacttagtgtagtaagttcattattttcatgaagcagagagaaagtatatggagtgttaaaatcaacctcatttaacttcatcgcattgtacggcattttattataactaattaatggcgttaaataatctttagctaaacgtgataatttagcgtgatcattttcaataacaagcgcaaatctaaactctaatggttttaataattgtgaatctggtgtaggcatcttaattcctgatggtcgtcccggacgccgaactaattcttctttacctaaatagccaactgatcgaaataacgtaattgccagggtattataattatccccaattacttcatattctctaactgaattagtgagtaaagctaatggacaacccttgattgcaacgtaactaagcattggataaatactatctggccgctcgctccaattatcttcttgccatgattctatcgccatatcttttactgggcgttcaattatcccaaactgattatcactaactgaggcctgagcccaaatatcagttggaagaagtactctaagtcgatgatctttagctgtattatcaatattagttgtaatgtcaagatttcgttccccttgttttaattctatttgaaattcaatttttaaacttgtatcacatttcttttgtttacgacttgttaaatcttttggtactttcatttcgacaattatatgagctgtagtagaatacctggatctattgatttgataatctgccttagcatctttagaagttatgatataatcttccaataatggtgaataatcataaccatcaccctcatcactaccatcttcaatcaataaaacggaatcataagtatgatcattaactaaatcatatatttttaaagttccattactattaattttaatctgatagtattcattttccagaaagtccactttatctaataaaatttcttttggctctactgcttcttgaattaaataagcctgatatcccatcgcaggaaaattatctttaaattcaattgtatattttataaatggatcataattcccataatgaacaatctgacgatcaattaacccagcatcaatgatttctttattaataacttgataatctatttcatgaccctcactagtaacaattttaaaacttttcattctcgtgataacttcactgcgaaccactcgatttcttggataagggagtaaattaaagaccgttagtttatcaagcgcaatatctttaggcattgcatcagtaatctttcgtttataaaagtcaatcattcgctctactttctcattagcaatcgtaaaacggctgcttatttcttgatgtactttatcactacaacaacatccaattgaatcatgggcatgatttttcattatctctttccatatcgattccatcatcccatcaaaatactcaaaccctaatttaaaagcaatggaagccaatggctctagcagattggtaattttattttcaattacggtattcattgttttgatatctgcccgtgatgaaaaaatcgaacgatgtacacgcatatatttaccatccagcagttcaccatgaaggatatcatagttatcttttttctctaattctttaaatatctgatcatagttacttaaaaagaagtttttatctggataaagtctttttaactgctcaatgacatcaaatatatttttttgtaatggcatttggtcgtgaccattaggaattaatatatgttcactagttgctcctttttgtaacactggcatatatttatcacaacgtttttttaattcatcaagatctgtgggtaaatattttccaattgcataaccaagtggtaatagttgagttaagacttttgaaccatcgtcactagtccaataaaactctgtcttatttgaacccattcgctcactcgttccccgccagaatatgcttcttgtaattccaaaaccgtttaaaatcattggcatttggcctgactgaccaaatgaatctggtaaataaccaatattcataggttctccaaaagtctgactatctttatgaccgtataataaattacgaacaatcgactctccacctacaaccatctcatcagtttgagtgtaccaaggcccaataattaatttaccttttttcactaaattaactattcgtgataaattttttggttttaatgctagataatcctcaagtacagctgtttgtccatcgagaacataataaggataatcctcattattttctaacatttctaatatttcttccatattgtttagtaataataactttgattcttcggctgaaaaataccactcacgatcccaatgcatatgggggacaatgtgtacttgatttgccatgctattcctcctattttgccttagctaatttctgttttcgagtaattacaagtagcaccgctgaaataatcgctccaattactgccgctccaaaccagacgatcatcgctaatggaatattatcagcagttaatacgaaaatagagaatattcctgccccaggtacatcaagaccaatattaaacatcgctacaatcgctccacaaactgcagaaccagtacatagggatataattacacgaattggatctgccatcataaacggaattgccccttctgtgattcctgctaaacctaatagccaggttgaatttcctacttcacgttcttctggtgtaaataaatcttttctaaactttgtcgcaaatgtcaccccaaatgcactaaccattttaattgaagcaaaagcacaatatggcattaaaactccttccgccattgcagcaacacagaaagcatatgcagctttatttactggtccacctaaatcaaaagaaaccatgattcctaaaacagcccctagtaaagcagcatttgttcctgccattgatcctaaaaagtcaactaatgctgtattgatcattgcaactggtttacctaatacgactaacaataagactccaacaatcaaacaagacaatacaggataaattacaaaactcacaaaaccggcaaatgttcctttagctggaatccatttctttaaatagcgtattgaatacccagcaatgatcccaccaagcatcccgagtaagaatccaccgccaacggtattagcacaaaatccagccgcaaaccctgaagctaaagctggtttatccccgattgaataagccatataagctgataataccggtaccatcaaggttcctaacaatccacttcccattgatttgatcaaataaagccaacttccttcggtattcatcaaatctgtaaaaccaaaggttcttgcaaagattacacaaattgctgcaatcattccgccagccacgatcaatggaataacatgactaattcctgtcataaccgcttctttaactgtttctaaaaatccggcttcttgatgtcgtgaatgttctacatactcaccacgagcagtttgttctgctttaactaacgctgtttcgataatctttttagcatcctttaatggtgcagatacttttgttttaatcgttggtaaatgactaaaacgttcctcctctttaaccgctacatcgacagcaaaaatagctgcacttgcattttttaacatctcattagtatgacgatcttcaattccattagccccctgcttttctacatatacatttactcccaactcttgcccagcttttgttaatgcttctgctgccatgtaagtatgggcaataccagcggcacacgcagtaaccgcaacgattgagcgatcaaaggattttatttcatcactattaaccccattatccagattttgataaaattcttttactgttttagaagcatataatttttctgtatatgtatgattagccatcttcgtcatcatttctgctaataattgcatttgaaccgaattcttatcattttggggaattgcaagtaaaaaaacatattgtactttgttaccttcaacaacactttcccaatccttcacaggtttctttaaagttacaaccgcaaaagctgcttctctaactactccatcttttccatgaggaatggccagaccattatcaatccctgttgatgttaagctttcacgttctaatactgcttgataaaaatcttcctcattactaatttttcctgcctgatataatttagaaactaagaatttaattatttcatcttttgatgacaaatcactatttaaagtaataagctgctcacttgttaatttagataattccatttcttctgccctcttcttttaattttattaatcaccgacatgtctttccctgattacaaaaatatcatagcatattattttgtaacccttttcaatttggaaaatcatacacttatttttaaataaaaaatggatgtaccgtgtatttatacacagtacatcctccaaaatacctctgtcaactctcgaagcagcatcatcatccctgttcgatctgcaacattatagccattcaatttttgttcatcaccccaataatataatggaatatgtgctaaaccagccaatcgattttcattaaaatgggtaaccgaaataacaaaaattccattctgttttgcttcttctacccaattattcaaacgaccattctcaccacttgcactaattacaaacaaaatatctttttcttcacaatgcttgattcgatattcaatttcacgataagtttgataatattcagctcgataatcataacatcgcaaattatcgaccatcatttcacaaaaatataatgactcaccgacaccaataaagtgacatgttcgggcattcttgatcttagcggcaacttcttctaacgttttataattaattagttccattgatttatacaaattctttgataataatttttgaatatctaaattttctgatacttcgttattaactaaaaatttcatctctgcaaagcctttataccctaactttttacaaagacgcatgattgagttgggaacaagataaagatcttcggctaccttttgaattgataaatgttccaaatttgctttatttttacgaatataatcaacaattagatcatctgtatcgtttagtgtaaactcttgttgtaagacccgttcttcaaatttcattatattatcctccatgacaagataaatatcaactctctcaatataacttatattctaacattattttttgatttcggtgcataatctttcaattctggaattgctcccgcagcaactgcccataaatacaaactggcaattgttgcatatggtccatagcgacgtttatatttagtgaatagttgaggtgtaattcgccgatgatgatagaccatgcgcattccccgtaaaattgctaaatcgctataactaattatatctttacgttgtaatgaaaatgttaaaatcatctctgctgtccatctcccgattccaggtaactcacaaagctgttctataacctcttcatttgatagatcagctaatcgctccaaatccaattgatcactaatgatccgtctcgttatttctttgatataatgtgcttttttcatcgtaatgccacatttttgtaattcctcagctgaaagtgatttaaaatttgctggggtaatcggactaaaagaattgttgattctctgccaaattgtttgatgggctttagtagaaatttgttgaccaacaatcgaattaactaaagctgcaaataaatcaggtattaccgcacgtttaattataccaatctgctcgattacttgttttaaaacaggatccctacttttcaaatattcaatttcaatatcgctatattcaaaatattccattatatactccaacctataatcttatcgcatagttacaataccatcattttaaaacaatcaaataacttttttgactatattgattagctttattaatttcaagtatacttgaagtactaaactttgtaaataaatgaaatattatataaatcaagcatgtttccttacgtaatcaaatagtttatattaccgcttttattcttatgattataaattgttagttcataattatctaataaagcacaacgataaaaatactctagtaagtttttactagagtatttcatttatactttaaataactcaataatgtcattagtagacattgttgttatactaccttcattattttccacaaaactatcagctaagtttttctttttattttgcagttctaagatcttttcttcaacactatccttcattaccaatttataaaccgttacaacattttcttgcccgattcgataagcacgatcagtcgcctgattttgtgctgacatattccaccaaggatcaaaatgaataactgcttcagcagcagtcaaattcaatcctgttcccccagcttttaatgaaatcaaaaatactgttgtatcatcattttgaaattgattaactaatcgatgacgttcttctttttttgtatcacctgttaattgataataagtaatactttctttctccaattctttagcaattaaatcaagcacggaagtaaaagaagaaaataatagcactttttgattatttcccaggaaatttcggattaaatcaagacatcccgataattttgatgaaatattcgaaatattatcatatattatccgtggttcacaacaaatttgtcttaatcttgtcaacattgctaaaatagcaatacgatctacattatcataattaagctgttcttgcagttctttattgacctgaattaaattagctaaatacaacttattttcttcttcattaaattcaattgataatgttttttcaatcttctccggtaattcagtcaatacatcttttttattacgtcttaagataaatggtgtaattaatttttttagttcctgctgtttgttttcatcatgatttttaacaatcggtgtttcataattagttttgaaataatgatagctatacaaatactctggcattaaaaaatcaaaaattgaccataactccgccaaagaattttctataggagttccggttaaagcaaaacgatgtttagcttttaacgattttactgttatcgcattcttagttttaggatttttaatatattgcgcttcatccaaaataatattttcaaattgataaccatcataaagattagcatcacgacgcatataatcataagtagtaattagcacatcaacctcattaaattttctaattgcttcttttcgtcgttttagactgccgtgaatacaagtacaagataaagaattagaaaatttatgtatctcatcttgccaattcaatagcaatgatgatggacaaacaactaaactagtttttttatcatcccgattttgatccagtaaaacaatcatttgtaaggttttcccaagccccatatcatcggccaaaattcctccaaagccataagaactaattgattgaagccattgatatccaaatttctgataatcgcgtaaaatttcttgataattaggcgctaagggataactctgtttagctatatttttaaaattatcaataatttctttaaatacggtactacgatcatatactaaataattgcttgtttcggctttattatcaagactagaagcccgatagacatccatttctaaatgtccatcctcaagcatctttggtctaatttgataatcagtcataaattcatttaattcttccagctcatcagaatcaagatataatagttgaccattttttaaccgatgaaatttcttcttcttttgatatgagtttaagactaacgctaattcatctttaggaatatcaatactttcaatgtcaattgccaataagtcattttctaaagtcactcctacagtaatactaaattgacttttcttcccaatctttttaagtgcatcactaaccatcacttcacaataattagctaaaaaaggcaaaccttcatttaaaaaggagtaagttttttcactttctaaattcaaatacatacaatgtttttcaaaatcaactacatcaccaatctcttttaaataatcttcaattaaatcaaaattaattgatgtttgctttctcggctgttgaaatgaataaatcgtttctaggccttgtttactttcaagataaactttgatttgttccaattcattaatatcgccatagagtgtcaatatttctgtttcgataacttcacttgttaataagtccccagtataattaaaatattgcttaatatcatttaaaatatatttaacaaagtcatttacatcttcttttgctaataataatttgtctttactttcgcaattatgaataaatttgattgcctttccttcatcgtccagcttaaccatacctatttcattttcagtaatcttataaagatttttataaccacaaaattcatcaaaatcctttaattcaagcgaataatatttttcaagtttccttatatgtaaagtaggctgataattatattgataaattgataaatgttgattagttttttctaaatcttttaatacttcatagatatattcaatactttcgggaataatctttatctcatttgtcacatgcgatatatcgtaataatattcctgttgataccgctcataagtgatcatacaaaatttcattaattcaataatcttcagtgcttcatcactaaatactttttgattatgaacaaacgctaattgtttaccatattcaacatattcattatttgctaatgcacttaaaaaattaggaatattttttattatatactttttatcacttcctactttgaattttaaacatgggtgcccataattaatcttgatctggacttcaagatcatacttttgatttagtttaacctgattaaaatcaattgctttagcagtcttaaatgatgctattaggttttttgttactgctaattcattttttagcagttcttcttcctgctgctgacgaatttgtactaacttgtcgaaataacttatcttaccatttttacttttatatttaaatggaaaatcatcaggtgataactcttgaaccttcagcaaaacagccccaatatgaccgcaagccgagagttcatcacaccaataacaattacaactatagtcagtaatcttattatcttgatcaataacgattttacacacattttcataactaccattatcaacaatgccttcaattgtataatcatcaaaaagtcgatcataagtaattgtgatttctctaacataatctttttgataatatattcgtcctgttcttagatttctaacactgcttacgattctatgtaattctttgtcagttacaagcacttaccagtcacctcctaattttctttaaaattatagcatatatcgaataatattcattagtattatgactaaactaaatacatagagttataaagatgtaatcttgcagcaagtatttatttcaataaatttcttattactgccataatcaaatttttaaataattaaatactcatttccacaagcattaataaacaataacaaatcatcataggtaattgatattgttgctgtattaatatttgggtgaattaataatcgttgtgctcttaattcacgatcaatcaatatttttactcgcttattatcattaattattcctaatggtgtcactgatcctggaattaactttaacaattctacaagttcttcatcactagcaaagcttagccgcttactaccaatttgtttagctatatatttcaagtcagcacgcttttcaaccgtcatcatataaatgaagaattgtttatcactactttttaaaaatagatttttacatgctactccatcaatttgctcattaataaacattgcttcttcaacagtgctaactgattggtgattaattttttgataatcaatacccaactgtgttaaaaatttatatatatccattgttaactcctctttttatgataatgattttaacatattaaaagtttaattgaaaataataaaagcatccaaaggatgcttaatcaattttctttaattcataatcaaaaccatattttaaaatatattcttctagagtccaattattatcataaattattttagctgctttcttaccaacataacgtaaatgccatggctcattagcagttccagtaatatccgaacgatttttaggataacgaagaataaagccatatttataagcatttttagcaacccatttatactcatccgtatcaccaaaaaccattctctttttatcaattacactttggctagttaaatctactcctaaccctaattgatgttcacttgagccaggtttcgcaactaaaccactagcagtgacttcatcataacggttaaaataatcattataaatttctacttgttcatcatatgagcgatatccactatttaaaactaaatgataatcttcttttaaagcatctttattcatatcttctaatgctttagctgcatcttttcgaagtttattatggttattatcaggagcaattggtatatcaggtacaacaagatcagcagggacataatctttaggtaacacaaaaccctttttaatcaacagaagtgtattactaggatctaaaacttcatattctgatccaacagcattattagcatcaataaatgggtaagtaaccgtaagtacagctgttattggctcttgattacttgcaagatacttaggcagatcctcaaagaccattccattaatctttaaataagatttaatttgcgaatatgtatatttattatcgacgattaccttaaaatcagacagctctgcaactttcattaaagataatacttgtttataactatattttaaatccttgagatcttgataataatcctgatagaaagtatcaatatattttattacttctttttttgaataatcttgatgttctttttgatatgtctgatactctaaataatgttttttatttttatattcattccaggaacttagatcactgaccttttccgcatccaaataacgctcaatctcattatcatttagctgtaaaataatgctttgttcagaccaaccatagcccttcgtcattaaccgaattcttgtaaaattaaatgcaatcaatgtcccaagtattaacatagcgattaatacactaatgattactttataagggatttttttcttttcattgtacgacatgtaactgcttcttttcaacctattatcctcctcgatatattcttggcagtcgacttcctaaacgactcaaaatctcattactaattgtattagcttcaagtgcaatttcttctaccctaatttcttctgtaccatcttgaccaattacggtgactagatcattatcactgatatcactaatctcgctaacatctacaagcatttgatccatacaaattcttccaacgattggacacttttgacctttgatcaaaacacttccatttgaagaaagtatacgtggcaatccatcaccatagccaattggaataacggcaattacactatcacgattaaccttataagtcaagccataaccaagactcgcgcctttagtcaaataatgcagcattgcaatttgtgctttaattgttaaagctggttttaaatctaattgtacttttgaataatcattgaacgttgagtacactccatacattaaaatcccaacccgagcataatcggcattgatttcaggataatttactaatccataactactttgaagatgaacctttcctatatcataatgtcttaattttaattcattaattaaatcataaaaagcagctatttgtttttgggtgtattcttgatcaactttccttttactatcacaaacacaaagatgtgtaaaataaccctgaatatgaataaactggtaatcatatatttctttaatactctcataatcgcttaaatcaaaacctaaacgatgcattccagtatcaatcttaatatgaacattgatcatatgcccactttcatttaattgccgagcatgctcacgatttacaatggtttgaatcaaacgataattatgtaattcaattgcacgaatgggatgactataaccaagtactaaaatttcgccatatatcccatgttctcgaagtttgataccttcatcgatagtagcaactgcaaaagcttcaattcccattttttgacaatgtttcgcaacttctactaacccatgaccatatccttctgctttaacaactaccattaatgaactatttttatttaataatgaactcaattcatcaagattatgcgtgattgcatctagatcaacttcgatccaactgcgacttgtgcgaatattcaccatacttctcttttcctttcaataaaatctctgaaaataaaacagttattatcaatacactaataaactgaatcagcgggtcaacaactaaatgatcacacttcaataatttacctattccacgaacaacaacaatcatcaagggatgaaaaagataaatagctaacgatagatctttacatttagatattcgtttgcctgatattcgtaaaagtccctgatatagccaaaacattactaccggcaataagatattcattgaatcatgacgtacaaaaacataatctgctgcatcttgataacctttcaatagtgatatttctataaacatcaaacttattgctaatatcgtgctaataacgattactcttaaactaaagttaaattgctttaccgcaagaagttttccaatccaaatgaataacggtgcaaagaaaataccatttcgtgtataatcacttattaaaaaaatcaagtcatacccccatttacaatatgggtgtatcaaaccataatacgaatcaccacctaatccaattaaataaagtagtaccacaattgaaaaactcgttaataaagatacccgtttatctaatactgcaacaatgatcaatcctagaactgttgctggtaaataccacaaatgatagaaagttccatcgaacaaaacatctttaattatttcataaatcagattactttgattaaaataatgattataaagatttaatggtaaataaataattattgctgctaaataaatcaatagtgtctgtttaataatcttatatagtcgttttttactgggattaagaaaatagaaataagcagttgtgataaaaaagaatggtactgcaatacgtcctaatccacgagttaaataaaaatctaaagttgggctaattgtatctaatggtgaagtatgaatcgtgacaactaaaattgcagcaattatcctaaaacagtcgattaagggataaccttttactttagacatatggcctccatgatgtaataataaaaccatcacaattatttcccgatatttgataactaccatgatcacttaagtttaacttagtctgttcattaactgctggaacataaaatacttcaactaactttccttggcattctaaaacatatggattgaaaatagaatgattttttatatataaatgatattcttcaaaacaccactgattttcttccataatttttgcatgaacaatcccaacatagcgaaaatgccatggttcctcactaattttggtaaaatcaattttatttttagaatatctctgaataaagccataatcacttgcaatatcacgaaattgttgacagatttcctgacttgtaaaatcaggacaaaagatatcaattgtttcattttttactgctaaatcaatggctagacctgtttgatgctcactacagttcactctagcaacaaacttatcaacaaactcttttccatgattttgaatagcctgattatagatcatagcttgttcttgaccgcttcttaaaccactgactaaaacaatcttatcttctgctttaatttcctgtaatgcttttgttagcatctccatagccgttttttctaatgatattgttgaatccttggcagtcgaacagttagtaatttgatagttatttgcaattggataattatgattaaccaatactaatggaccttggtaaatatcatctttatttaaagttaccatctgcatacttaagccctatcgcaacaattttatctattaattcactaaattcaaaacctactcctttcatcatctggggaaaacggctatgatcagtaaaaccaggaatcgtattaacctcattaaaaactatttcattgtttggcgttaaaaacatgtctaccctagcaaaattctgacaagctaatgtctgataaataatttttgcagtttcttgaattttccttgccgttacttcatcaattctagcgggcatatgaattgttgaagttttcaaagtatacttttcatcataatcaaaaaaacctcccgataattctatttcatctacctcaccaacagtcaattcatcgttgccaataatcgcacaacctacctcaaacccttcaacagcttcctctacaattacttcattatcgtaattaaaggcatattcaagtgcttttgttaattcttccactttgacaactttactaattccatatgatgatccagcttttaatggtttaacaaataatggaaaattcaatgctttaacattaaaatcatttatattatgtacaagcacagacctagtaacctttatccctgctgctttgactaactggtgagctcgatatttatccatacataatgctgatgctaataatccgcagccaagtactggtatttttgcaagctccattaatccttgaacagtaccatcctcaccattttttccatgcaagaccggtaaaaccgcatcaatttgctgatagattattttattatcaactatttccatcactgcttgtctttctggttctaaacataccgtcactggattaagcagttcttgattccaagtatcattactaattttttcaatttccccatcataatgaaaccactgtcctgctctcgtaatcccgattaaataaagatcatatttttcttgcggaaaattctttataatcgcagctgctgattgtagcgacacttcatattcacttgattttcctccaaataaaatagctattgtttttcttttcatattatatccttccttactactccttcgataaatctataatataaaaaaaacgctcttcattttttaatttcttcataagaaaaaatcacaaaattcccacttatttcttacatttttcttacaaaaaaatcagcattctgctgactttactgttaaatattaaaatgctttttaaaactttgagcaatcccatcattatcaacactatcagttatttcacttgctacactttttaatttaggaatagcattccccatagcaataccatgtttaaccaattgtaacatctctacatcgttgataccgtcaccaaaagcatacgtgttttcataatcaattcctaatttttgatataaatattcacaagcagttcccttagtgaaccctttgcaataaacatccattcgaatcaaacctgtatcatacggaatcatcgtaaattcatcttctaattcatgataagctgcccacaactgtgctgcactatcaaataaaacacaacagcttaccgctttaacatcactagttttaaatacctcattaacatcagttggtctttcagttgttccctgaaacatagcacgatgttttataaccaattcatcatcaagaaaactgcaccatgcaccaccgcgaccattaaacattgaacgaccattatattttgcatatacatctaattgcttctgcaccattccattatcaaattgttcatcaatcaaaatctcattattaaaacgaatataatgtccatcattacaaatatacccatcaaattcaatgtttgccacactttcaggtacttcaccccgagctgttgcaatgacgatcttattaccttgatttttaaattcatttaaaacccttattgtctcatcagttggatgtaacatcccattaggtacattaactaatgtcccatcaatatcaaaaaacgctattttcgtattcataatgctcctccttcttttaagtataaagaaattcatatcttttatgagatattttaatattatgaaaataattactgaatcacataatcttttgcatgatcactgtaataaagagcattgtttgtatcaataaacacagcttctatccccgctaattgatttactaatgctaacccctgctctttacctaaagtaaaacatactgtgcttaatgcatcaccatcaactgaatgattactaataatcgtaactgaagctaacccattatcataactatatcccgtcttcggatttaagatatgatgataatacttcccttcaacttcaaaataacgttgataaattcctgaagttacaaccgactgatcattaatttttaattttaaaatgtcactacttcctttaggatcagtaataccaattgtaaaatcatcactattctttttccctacacaaagaacattaccacctaaattgataattgcactgtctactccctgctcaattaagtattccttaattttatcagcaatatatccctttgcaacagcccctagatctattatagtattaggattactaaaactaattgtactatcatttaaagtaattcccctatatccaatcgacgtcaaagcaccggctattgctgaagtttccggcaattttggagtatcagctttaaaatcccacaaatcaatcaattgtcctactgtaatatcaaaagtaccattagataatttactatattccaaaccaatatttataactttagcaagttccttggatattttaattggtttagttttatcttgatgattgagctgatataattcacttttgggattagtccgggaaaagagaagctcgtagtccttgcaaatagcaaaacattcatctagaatattagacgaagcacaatcatataaagtaatcgtaacttgcgtatctaaaagaagctgcgtttgacttagaggctgtttattcatacatccacaaaatataattaagattattaaaatttttataaaccaacgttttttcatgtcatttcctttcattctggaggtagctatgtttaagaagaaagacttcattattattttcataatttttgtcgttattatcggggcactactttttaatcatttttatttcagtcaaaaagctgcttacgtgaaaatcaccgttaataatcaagtatatcgtactgttcctctagagattgatcagacaattaagattagtgataaaaatatgatcgtgatcaatcacggaagtgtacatatgaaagatgctacttgccctgataaattatgtatcaaacaaggaacgatatctaaaaatggtgaacaaattatttgtttgcctaatcaagttgttattgcaattgtttctaatcaatataacgatgttgattcatcatccaaataggaggccccaatgactaaaagaattacctatttatctttactaatcgcaatcgcaattattctcggttatcttgaaacctttattcctattaactttggaattcctggtgcaaaactcggccttgctaacctcatcggattaattgcactatatcgctttggatttagagacgctttaatcatcactctcctgcgagtttttattattgccagtgtttttactaactactatatgtttttatatagtttaagcggtgctttattaagtttagtcattatggttcttttaaaaaaaaccaaactcttttcaactttgatcattagtatttccggcgcaatctttcataatctaggacaaatcctagtagccttaattttctatggttttaatattatttattatctaccttatttaataatcttatcacttattacaggtagtgtcattggtatcttaggccaaattattttagccaaactacctaaacaactatcataatgaattgttttttactaaaaaaaggaatttcttccttttcaaacaacaatataactctcatttttagcagcaaatgaaatgatcatgtaatattttatattgggagagaaaaataatctacatgatcacttactttgctacgatagtactatactccttaaacattactttaagtcaatctttttttattaaactaattgccgattcatccattttccactaaaatagcgccagataaagaaaatacaacgaactccccaatcaataaacattgcaatccaaacaccaattaatccaagattcatatattgtcccaaaacataactaaagcataatctaaatattagcattgatgcagctgaaactatcatcgtaaacttagcatcatttgctgctcttaaagcatttggaaatgtgaatgacgtaggccagattaatgctgcaataattgcatgtaaaaagatacattggtatgcaaggtccgtcgtttcttttgataatgaatagaatgttaaaattgaaggtgttgcaataattaaaactacaattaatccagccattgaaagataagtaatttttaataactttttaacataatattttgcttgtttataatcatttgcacctacacattgacctacaaccgtcaccatcgccaaagacattgccatcccaggaataatctgcatttgagccaagttattcgaaacagcattagctgcaattgaatatgtcccaaaagttgcaattaaactttgtactaagattttccctagctgaaacatcccattttctaatcccgaaggtatcccaattgctaaaatcttttttatatacataaagtcaaatttccaatgaagataatcatttacacatacatcattatcccgatgacttaacatctttaaaattacgatacaagctactgctctggcaatcagcgttgctaatacggcaccaaataccccccatctaaaaacgaaaataaaaattgcatttaaaataatattaataacattcatgactgcactattaatcatcgatattttagagttaccaattgccctaaataatgctgctccagagttatataatgcaataaaaggatacgacattgctgaaaataaaaaatagatttctgcatttttcattacatctacttcaacatttccaaaaaccatgtgtaataatggcacattaaatgcaataactatcaccatgataattactgacaataatgctgtaatcaaaatcaactgttttgctgaatactttgccttatctttagaaccctgtccaataaactgggctgcaactactgctccccctgttcctaatgcagcaaaaatattgattaataaaatattaattgcatcaaccagcgaaactgctgatactgctgcttcgccgacgctagcaaccataacagtatctgcaaaacctactgtaattactaataattgttccacaaccaagggaataattaatttttttaatgctttgttatcaaataacattcctcacgccccctacagttacctattatacgcccatattcttttgaacaaagtaaatttcattttctggaaaagcaaaaaaacctcacaaatgaggtctaaaaacaaattattagtctaacaatgcttaaacaaagttatcaattctgttgaggtcaagtctcgatattcccctaaagctaatttttgatcaagttctattcctgcaaaagcaattcgtttaagtgtacacacttcattttgacatgatttaaacatttttttaatttgatgatacctcccctcattgatagttactaaacaatggtattcatcaagtatttccaataaactaggtaaacattgaaccttgtgatcaatcactacaccatcagagaattttttaatcaattcatctttaagcggaaatttagtagtcacataatattttttattaacatgattttgtggtaataataatttttttgatagtgaagtgtcattagtaattatcaatagccctgttgtatcaatatctaaacgccctaaacaatagcaatcttctcgcccaatcagatcaattacacactgatgatatttatcatgatttgcacaaagatagtcagccggtttattcatcatataataaacaaatggctgggcattcaattgaatatgatgatacataataatatcatccgcctttactggataacgaacatctgtaattacttgatcgttcaccctaatttccccatgcctaatcaaggttttacatatcttgtgattccctagtttattcttcattaaaacataatatagatctttaattcgactcacctccattttagaacttctttagcaaactttttagctgcctggatatcctttttatcaggatgtccaaagtttttaaaaataaaagcacttcctttacatgaaaacaccggtccataaattattcccttttctttaagctgtgctttaacattagtaaattgatctgttccaaaaccgttagcagaaaataaaataaccttcttaactttattagcatcaagttgtgctacaaacctagttacttgttcaggaatatttcctcctaaaattggacatcctaaaaataaaatatctgctttaacatcttgcacttgtttaatatttttagcatcgacttgaagttcgtcagcaattgccttcgcaattttcttattattctttttacttttatatattacttcaatcatccttctgcccccttttgacgatttttaaaaaatacttctaaatgatcgatcccatgcattaatttaattgataactgataatactgagtgatttcttcattactaaattcactaaataaagcttgatgtacctcatctgttaattcttccatatcttttctaaagcgcaatccctgtttactcattaccacacataacgaacgtgcatctttgggtgacttctctaaaatcacatatccctgcttttccaaactcagtgctaatttttttacattttgtcgtgaacaccccatcacttttgctaacatgcttaaatcaggagcatcagtaaatgaagtcatcgtagccattaataaccattgtttactcgtcatttcattgtaacgatcaaatatcgcatgtaacttattctcctgaataaacacacccgcaaataacagttttttgacccatttaggatcctgtcctaataattcataacttgattttttcatcattctctccatatccgtaactagttacttatttttattatagtaactagttaccaatctgtcaataaacaaatactttcatcagattatttcataataaaaagttataatgacttctcactataacctctaaaacagatattttaattttcgattgatcttattactttacagggatttccacaagcaacactattaggagcaatatctttagtcacaacactgcctgctccaattacacagccatcgccaatcgttacccctggtaaaataactacattaccacctaaccacacattattaccaattttaattggtagcgcttgttctaaaccagtatttctaattttatattcggtaggatgaatagcagtatatagaccacatgaaggtcctatataaacattatctcctaattcaattccaccaccatccataaaataacaattactattaataaaagcatttttaccaattttaatcttatttccataatcacacataaagggacttataagctctatgtttataggttgataacctaacaaacttgtaatcacttctaatcttttttcataactgctaggttttatgtgatctagatcaaaacacaaatctttagctaatactctttgttttaataattcttcatcattatttgcatcataccacattcctaattccattttttcacgttctgtcatttttatttcccctttattccttcttttaaccatttcatactaatctctgcactaggataccctgcaattaaaattgcctgtgcatgtacaccataatcacctgtttgtaccactgctttacaacgatcacgcatttcataatattcaggaatgtaatgcatcgaatgaatatttttctttcccaacaaatcaaccagtaactgataatctttttgatttacttcaatcatatcttctgtgacgattgctccttcaaaatcaccacaagcaactagtgtagttactatatcctcaaaacttggtgaaccggtcactacttctacatctatatattcaacacttgaatccagtgggtatagggctttactagatgttccactgccagcatcagcaataaataacatctcaccatgacgcagactagcaacaactgctgccaaacgttcatgaagaattctcttttttggtttcacacttatctccttatttattaaaagtcttttattaattaataattataagttatctaataaaaaagtcaacaaataaaacaactgtccttgaaccgtcctaatcaaataaatagatgaaacaatcaaattattagatttgaagttatcaaaaataataacttcatttattatttagaaataaacaggttaagctatgcaaatattattactatagtgttcagtctcatatttcataatctttttattttctggtattgaacatcaaactgataaatctgatgataatactgttcgtccaacaaacatataaatccatatttctctttcaattcaaggaaagatttatgattatttagatgttctttgacaatttctaatttatacgctttagcatacttttgtcccctcaacaatataaaagttcctattcagtgtttaattatttacactatctaggaggtttttatatcaataacagttgttttatttgtcttgtttaatgaaactttctctaataacttcctgtattcccaataaataatcattttcataattagcacaatacgttaattcaggcataaattcacttggtaaatactctaaacaaatcttcttgatttttaatatatcatcagcctcaatagcttcacctgttaaaatcacgattgaaggatttattatcgatgctacacaacataatgataaagccacatcttctggtgaataatcaaagcataactgttcttgttttaggtatttaaaaaatggtaaatataagatttcaccagcaatactattttctccttctattaatttaccattaataacactcccacagccaggtccagaatttaatggaaacgtcacataacaaagatcctttttattattatgtaaatagcagccataagcagtataattcatatcatttttaacaactgtctttaatcctgtagccttctcgatttcagctttaagatttacattttttaaattaggaatatctgattcaattactatctctttagaaattattgccggtacccctaaaccaattatttggattctcgaatcttgtgataaaagatatttaatgaattttaaaatatcctctaattttaaatcatttactaattctttaccctgttttagtacacttgcaagggcatcaatgatttgccagcaaagataatctctgcctctttttctttgtacaaataaacacaatgaatgaaaatattctggattcaatccatattttttagtaggacgacctttttttaaataaataatttctttttcaacaacagttccattatccaaaaaatcattaagaatcgttcctactgtagctactgtcaatcttgaataattagctagttctttttttgtcacttcttgatgtcttaataacaatttcaaaatgatttgatcatttaaatctcgtagttttccagttccaattctattcacatttatcagcccttttcaattatttttgattatatcagtatttttaaaagaaaaataccctttgtctccaaagggcttttaattcaagtacgtcattaacacattcattattatatgataaaaatgtcttttgggcaactgacaaaaagagaatatttaatttttttatttttatattgacttatagttaactctaagttctatactataaatgtagaaaagataaatacatgaaggaggacttaaaatgaaaacatggttaattacaggatgctctagcggaattggacacggcattgctaaagcggtattaaagaaaggggataatgctgttgttactgctcgtgatacaagtaaaattgccgatctagttgatcaatatccaaatacagctttaggagtggctctagatattaccaaaaaagagagtattagtgctgcagtaaaacaagcacaagaaagatttggaacaattgatgtattgattaataatgctggatatggatatcgttcttcagttgaagaaggtgacatagatgatgttaatcttttatttaatactaacttctttgggccaatcgaactaattaaagaagtattaccacaaatgcgagctaacaaaaacggtgctattgtcaacgtatcatcaattgcagcggttagatcgggtgtaggttctggttattatgctgctagtaaggctgctttagaattaatgactgatggtctagctaaagaattaaaaccgctaggaatcaaggtcatgatagcacaaccaggttctttccgaactaatttttatgatacttcactaaaagggactaaaaataagatcgatgattataacgaaacagctgggaaaactcgtaaagagaatgtcgttaatcataaaaatcaacctggtgatcctgataaaggtggtcaagttattgttgatacaattgaaaaagacaactatcctttccgtcttctcttaggtagtgatgctaccaagatcgtagctagtgctttagaagaaagaattcaagaaatcgaaacttggaaaaatattagtagtcaatcagattttgaatagaagtaaagcctcctaataaccggaggctttactttgattcagttattaaaatgtccagtacaaaaatgttcaattatttctaaaacttctgttaatttatctgtttcaatataaacttgagtctctttaacaaatttattaataaaattatcatcaaaatttccatcagcttgtcttttgaaactttcttttaataaatgctgtgctgcatcttgatactcaggtttcactctttttaaataatattcataaaacttagtttgtccatctttcacattccattcactccttgcatctatcattaccacaattactttaataatacttagtaatctcatttttattcattgcttatacatataaaatcatttttcctaataaaatacactcctttaaactaacgattttcacaatttccaagatatatttttccattttataaactaacttatctacctataatgtaagttaacacgaaaaagcaataatccccggctctaagacactaacaatcaaaatcttccagaaataagagaagactgccatgattaattatatctggcatacttatcccaatttttctaatatcttggtattttattaatataacatttaaaatatcatatatatcttctaaaatggttcaattcttagtaagttcttcatcaagaataataatattttgttcatcataaatacgatgcatcaaccaaacccgctcactgattctaatgactgagatacataagatcttaacacctttatgggttgccattttcaatgacaagggttcaagtgatataactttttccctcaatatgatcaatcttatcttcaatcaatgtaagagcatgtctagcatcatatttagtaaaaatttgtggtgcttaaaacaattacatcatagtgatttcctactgcaaatagcttactataagatatcgtaaagaactagttgttaatccaccagtacaactgagcagtactctaattagtggccgtataaccattttttatactctctactattttttcaaataccccaatcgtttgcttaagcgtcctcacttgaaaatgcaaataaaaaatgcgcaaacccaatatctagatttacacattactgttacttgattattcgaattataacaactcagtttattaaaagccaagaaaagattattttactaaaataaaaaagcctatacggcttaataaaaaaataaaaatagtcactgattaaaacaaatagtgtcaatagatattttagggagtagtgactatttatacaagttatctaccttgcactattataatctctcatgaatgttaatttaatatgaattaatcaacctttttataaattattttatttatttttgaaatttaaaaaagtgcatctttttaaagatacactttttattatcaaattattcagcagcttctgcagcttgtttgttttgatatctttcataagcaattaagaatggtgcataaattaagatagatgctacgattgcaattgcttgagatacagcacccatgatattagctcctgtagttaagaaaccatgtaagataggtggtgttgtccaaggtgtattgattacagcttttggacagaatccaattacagttaatacataaccaagcattaaagtaacgattggtgctaatacaaatggaatacctaagattgggtttaataccattgggataccaaatgtaactgtttcattgatgttgaataaacctggtactaatgagatacctgcgattgtacggttatcttcacgttttgagaaaactaagatagaaattactaaaccgattgtaaccccagaaccaccaaattcaccgaacatttgtaaccatgccattgcgaagatgtgtaaatcatcacctttagcattatttgttttagagaatgtttcgatattttctaacattaatggtgtaaataatgcttcttttactgcagataacatgttgttaccatgaatacctactaaccagaataatccgataatgatataaataatgattacccctggaatagttgatccaattgcacctaaaggtccttggatataagttgaaattacgtcatttaaatataatccagtaactaattcacatccacgtccaattaacgcaatgattgctaaagtaattacagctggaattaaaacttcgaatgcacgagcaacacctggaggtactgtttcaggcatttttaattttaatccttctactttacgtaatgcacagaagatttctactgaaacaaccccaacgatcatccctgtaaataaacctgttgctcctaaagcaccaccagcaacacctgtaaatgtttgtaatgctccatcagctgttaattctaatgtttgtttagcagtgtctactaatgcatagttagcccatccactttgagttactgctagccagcaagcaagtcctaataaacctgcgaagtatccagtttcaccattagcttcaccgatttcttgagcgataccaaaagtaatcccaactgtgatacaagaaattgttgcgaattgcattgctgcaaacgctgggttaattacttctaaagccatgataggtttccagaacatacctaaccctgaatctgcattaactaatacgttacaccataaaaccccgatcgcacctgcgatagtcaaaggcatgaatgtttggaacgcatttttaattgcagataaatacttattttgcccacaccacgcaccaacgcggccaaggacatctgccattttgtccataattcttttcctcccttattgactacctaataatagcaaagggtgaaatacttggaaacgctttccccacattctgtaagagtcttacaatttttttaaaatatttaaaaatgatatgtaaatttattacatatcatgatctgtctttttttcatatttttgttcacaatttatctttctaattaagttaggataatagtctttttgaaataagattgaaaagattagatccattaaataatcactacttaactttgaagaataggtttctattttcgaaacaatattttctttactacacattgttaagcaataattcgcccgttttcttaaataactatcatttattgaagtaattgcaataatagttcccttattatccacaatccgatcaactatcgtttttatttcatgactctcaccagaataagatatcacgattgcaactgtatttttatttacaaataaagaacgcttatcttgatcatttggtgaagatttaaaattaacaaagtgatcgatcgaaatcatccgatgctcgaataatagtcccgaaagatacgaagctccaacagcaaaaatatcaataactgatgtttttaataacttttcaattacttgattaagtacatcatagtcgagtaatgctttagtcgcctcaatcgtatctttatataactcgcctaactgatttgtgacttcttgaatactatcattctctttaaaaggtcgattgtaatcaacatcagtttgataactagttaaaactgatgaagcaaaattgatcttaaagctattgtagtttttttcacccagtttcttgcaaaaacgactgatcgtcgctgttgaagtaaaagtcgcctcagctaactcaactaaacgcatattagccacttcttctttatgatcaattatataattagcaatccctttttcaatgtcactaaatccttttttgtattccagttttgataataaactcataaactacccccgaattactttataaatattgtcccaaatttttttccattataacactaataagggcatgttagtcttttttaacactattttaacactattcttttttgatttttctaaaataaaaaagcccttttggacttttcatcatttagattaaatagtcactaaattaaaatataaactgtcaatagatatcttatgagagtagcgactatttctacaagccaactagcctgtggaaatataatactccattgttttataaaaaaatataaatttatataattcaggatagtattttcaaaattagcaattttaaatattaaattatgaaaattttttacataatttattttttattttcaaagtcaattacttttaaagcagtagtaacattactttgataatcctttacaagtaaagacacaaaaatgacatctagaacatacattgttgcagtaaatgatgtaatcacttctaaactaaggatatcttgtgacgagtaaacattgaggtaaatatcacaatagttttgtaattcaccctttttaccaccaattgcaataacatagattcctgccttttttaaatatttagcaatcttgatcatctcactattattgccagtaaaagaaataagtatggctacacattgacgactatttttttgtgataaaatgaaatgttcgttgattccactatgtgcatcgcactcttttcctaaagtcatgattttaaaagcagcttgactggcaatcgtataactaattcctgttccataaatagaaatacgtttagcttgagataaacgattaatcacctgaatcattttattttgatctaaatccagccttgtctgtactattgatttatcataaatagttgggataactttaacaatatcttgatatgtactgttttcatcaaccggttcatcttttaaaagactactaattcgacttaattcattatactcaaattcaacctggcgtttaaattcttgataactattaacctccagctttttacaaagacgtattactgtagccttactcgtataagtttcttttcctaattcttccactgataattgatataactgttcaggatgttttaaaacatactctgcaattagcttttcgctattagtaaagcgtttcctctcccttagcttctctaagatcatcactatcacctcatcttttcctattatgacatagatatcaagatgaaacaaatttgaactaatcaattatctttttattaattaaaataaaggagattgaaaatcctcctccattttacaaaacagctaaatatcatttaaactttcaccgttcgttgcaataactttttgataccaccaaaaactcttcttgggataacgcgccaacgttccactaaaatcatcatgcacatcaacataaatatagccataacgtttagatacttgacattttgtattagcaacaatatcgattggaccccaacttgtataaccgagtacttctacaccatctttgattgcttctaaaacctgctttaaatgctcttttaaataatcaatacgataatcatcatttactgtataaccatattgttcatctacaaccaaaatatcctttgccccaagaccattttcaacaataaataacggaagctgatatcgatcataaaattgattaagaatatatcgcaaccctttaggatcaatctgccaaccccattcagattcttttaaatagggatttttaactccgctcattacatttccccgagcttgttgattaagtttctcatcagctgtagcacaataactcatataataactaaaagaaataaaatcgactgtattttttaaaatttcttcatcttctttcgtgatttctaaatgaatatgattttcttcaaaaaaacgtagcatgtatcctggatattttcccctaacatggacgtcagcaaagaatagtgactcccgatcacgtcggactgtttcctgaatatcttcaggctgcggggtcaatggatagattggactccctgcaatcatacaaccaattttaaaattcggattgattttatgagctatttttgttgcttgagcacttgcaacaaactggtgatgaattgcctgatataaaacttcgggattaatttgatcagcttttcctttaatcccaccaccattaaagggggcatgaagaataacatttatttcattgaatgttagccagtacttaaccttattacaataacgttcaaaacatacttgagcaaagttaagataaaaatcaattactttacgattcacccatcctccataattagtcgctagatataaaggcatctcgtaatgtgataatgtaactaggggttgtattccatatttagctaattcatcaaaaacatcatcgtaaaactgtaaacccttttcattaggaaccgtctcatcaccatgcgggaaaatacggctccatgctatcgataagcgtaatactttaaatcccatctgagcgaacaatgcaatatcttctttatagcgatgataaaagtcaattgcatttttctttaaataattatctaatggcggaattgcttcattaccaaataccccttcaggcaaagcatcagccgttgaataacctttgccatcttctaagactgcgccttcacactgattagccgctattgcaccaccccataaaaatcctttaggaaaatttttttctaccatcttcatgactacacctcttgcaatttatttagtgcaaaagtcaataccgcttttccatccatcttgccataatcgcgcatatctattaaatatgctggtactccattagcatcatccgcaatacttttttctagataacgcacctgtggtcctaaaagaataacatctgcatcttggctgtgattttttacttctgttgctccgactgcccagatttttgtttcaattcctttttcctgtgctgcttgttccatttttgtaactaatagactagttgacattccaccagcacaacataataaaattcttatcattttaattttcctccatctcatcaattctttcaattttaaaaattactggtcttgtcccatcactacaacaagcaatcatcatcttttcatcattagtccagcctttcataattgagccaccttgcaaagctgcataaatatagcgactgacggcatcccaagcctcactgcaaaactttccattcatcatattccaaaaatcatctttgccattaccacgctccaaaataaattcctgtccctctttaaacaatggacatttaccaacttgcggatccgctaaatattgatccgctaaatcttgataatactctcttcttaataccgtaattttacacttagacatctgtttgctcctttcaaatccttttttctacacttttaatttaacatcagaaaataaaagaaacaacaagctcgtaaactgttgttccagtgtttcatttatatattatttttataatttattttgatacttgtggtccactaaaggcattttttaatcgttctaaagcttcttttaagacccaagtagggcaagcgatattaattctttcaaatccttctccttcttgaccgaagacatatccctcatctaaatatagatcagcagcaatcattttcttctctaattctagatagtcataacctaaatttctaaagtctagccaagctaaatatgttccttctaatggatatactgtaactgatggaagatttttcttgataaagtctaccagtatgtcatagttatgatgaatcaatgtcttaaattcagctaaccatgcatctcctttagtataagctaatcgtgttgcttcaaaagataatgtgtttaatgtaaaaaatccttttttctcttgttgcgcaataaatttagctcttaattctttattcttaataataatattagatccttgcaaacctgcaatattaaaacttttacttggtgctgtacatgttacagtaatatctccaatcacttcacttaaaacagcaattggataatgtgtataccccggcatagttaaatcttcatgaatctcatcactaagaattataattccattatttaagcaaatatccgcaattttttctagctcttcttttgtccatacacgccctacaggattatgaggattacaaagaatcaataactttgtatttgcttgttttgcaagttcttcaaatttatcaaaatcaatttggtaactattttcatgatttattaaaggacatctttgtactcgacgattatttaactcaattgcccgatagaaaggataataaactggcgtaaaaataattactccgtcattttcttcagtaaatgcagttaccccatcgcttaacgctggtactacaccattagataaaacgatccattctttttcaacttgataattgtgtttatccttcatccagttaattactgcatcgtaataagctgctgttccatttgtatagccaaatacaggattattctgcataaattcaagcatcccttcagcaatctctggtgctaatttcaaatctaaatcagcgactgaaagtggagctatatttttagcaactgcaggattatgatctttcatcccgttccatttagcagaaccattttgactccgatcaactaatgtttcaaaatcatatttcatttctctacctccattattaagcacctatatagttaagtaccttaataatagtatactctcacaatttataaagtcaaataaaaagaatcataacgattcttcattgtcttgtgcatattctttatttaaagctctttgaaccttaatataaatatctatttcttcattgctaaaactaattaaattcttaaaataacgtttcataattttcttatcaaactgaccatgtaaatcaaaaatctgcctcccgccaaccgttaagtataaattatactcacgattattatgaggattcttggttcttgaaattaatcctttttgttctagcttctttaaaatttgactgctggcacttaatgttttttttaattctttagcaatcatcgaagcatttattccagggtgatttccaattattgcaagagtgtgagtttctactggataaagcatcactttgccaaattgtcgaggtttactatcatattcttgtattaaatcataactttcgtcaattactttaatcatattatcaaatcgctcttgatccacaaaaatcacctcaggtatcattctatcaaataataaccaatgttgcaaacaatcataaaaagactggttttaccagtctttaaaggattacattaaatgtgattctttggttgtgtattcttgaactactttttgaatcttttgtggagtttctggttctaatggataccagcctttagaatacataagatcaaagacctcacgttgaatctgatatacctctttttgaatatctattaatttatttgctagttgttgatgagagcattcaatgataaaagtcgtataatcacttaataatgattttaaacataatagaacatcattgattctatcataatcattaaacgtattttcatttggtaaaattggttgtttcgttggatttgaataattttgattatccatttaaacaccccaataattcactataatgatttttaattgtgctattaacacgtcctaaagtcatcttaatatcattatcttcaacactttcttcgtaagcctttaacttcttcgataatacatataaactattcaattgatcattaaaagagccactatctttagtagatatcatttttggtggttgattcataaaattcctccttcaataatattttggttcttttataaaacaattatgcataatcatatacaaaagattaaaataaaaatattttttattttctacttataaatttttcaaatctgactaatactagagtatctttattaaaaaataaaaaacattattatcttcaataatgtttctttaccaaattaacagccctaaatttttatcctgctacttttattttattttcaatatatgccattactgcttctttagggatatttaataccgctgcaaattcttgatgcagtagatcttctgcttcttttttgtcccgctcatcagtttgacttaatcgcttattttgtaacaataaatttttttgctttgcttgaagattacaaatcaattgaatcaagccatcacaagtatattgacttatcgtttctttgtaataatctgttaattgtcttaaattttgattttcaataatctctttttgtactttaggatgtctggtcaataatcgttctaactcctctatcgaaatcaaatgacgcatatatacttgcgtatcaattggcacatacgtcttaccgtccataaaaataggatttaaagtataatactttcgggaattgggctgcttaccaatactaattactccaatattttcaatcctacaaacactttgattaccatatataatcaaatctcctttttcatacacataaccacctagctttctattaagtatatgcttaatatatctattataccgcactattagttactatatgcaaaagtaattaaaatatactaaattttcttttttatgcagctaaagactacatctttttatatttgattttactatttaaatcttgttaataatttcaacagttttacatgtttcgtatatcattagggcttgctttagcaatgatggtgacagtattttttagctaaaaacctttattgttgtaatatcgttaatccaactagaatttgttaaaacagtaagatagattgaccatcgtttaattggtatttcactttccattcaatattttattcctaatgaagatactattttagttgaaatattattaggtacttcggtttatttttaccagaatataaatataaataaattatcaatattgacagtgcgctaaatatatcgatcgatggttcttttagatactaaaacagcaatagaaaatcaacttattagtttaatcagtgaaatatttatttcatgaccaaactaatattatctactaactaaaaaatgcagaccattgtttgcctacattttttgtgcatattcttttactattttagaaatcaaatttaacaaagcttcttcgtcattaacttcataatcaggtttaatatccattgctttaagtccctttttatttaaccaaatacatttccaattagcatttttggccccaatcacatcattttcataagaatcaccgacatagatacaatctttatccgtaattaaattaaatatctgtggatctggttttgaataaccaacaaccgatgaaatgtagatatcctcgagagcaacccagttgctcatctttagtctacgtaatttttccatttgatgacaagcaggtccattagtaattatccctattcctatatgattatcttttaataaatctaatatatctttgattgcattactagttgtaatgtcttgttgatatacataatattttgtttgaaatgctaaagcatgtgcttcatcaatttcaagataatattcttttaaggctgcttggatacgatagatatacatttcatttattgtaacttgaccagactggcttgcctcaaatattttatcactatatttacgaaatttgatatataggcaaagtctttattttaggaaatatttcaataaatgcctttttaaatggaatgaactgatcatatagcgtgtcatcaacatcaaaatagaatttcatctttttaccgtttataatttattaatcatttttacaacattatctactgtaaaaccatatcttttaaacagttcatcagcaggtgctgaagctccgaagctatccattgttatatatttgccttttaagccaacaaactctccccaggacattcttgaacccgcttcaattgcgattctcttttctatacctggcggcaggatactttctctatattcccggctctgctgtttaaatatatccatactcggcatacttactacccttatcgctttgcctctgatccgtttctttgcttctactgccaatgtcacttctgatcctgaggctatgatgattatttccggtgttccttcacactcatcaataacatatcctccttttaatgcttctcggctagatcctttgatctgtggtagattttgtcttgataaaaccagtgctgttggtgttgtttttgatgtcatcgccagataccatccagcattagtctcctgtgcatcgcacggtctaaacacattgaagttcggcatcgctctcagcatcgtcagctgttctaccggttcatgagttggcccgtcttcacctacaccgatactgtcatgcgtcaatacatatatcaatggcagattcatcaaagctgacaatctagccatcggtttgacatagtcgctgaatacaaagaacgttgatacaaaagtcttcaatccaccataaagcattattccgtttccaatccctgtcatcgcctgctctcttactccgtagtgtaaattccttcccctgtaattctcggcactaaagtctcctactttatttaaatatgtttttgtagatggtgctaagtctgctgaaccacccatgaaatttggaaatagttcctttatccggttcatcgcagttcccgacaaatttcttgttgattcaggtttattttcaaatttccagaattccacatcgttttcaagtactttattatagtccacctcaaaatactgcttccataattttttcatctctggatatgttaccagataatcatcaaacatatccttccaaatcttatagattacctcgctgcgttcctgctgttttgctgtattgagataaacttcctcatctatcgcaaatgtcctatcctcatcaagtcccagtgtcctttttaattccctgacattttcttcacccagtggctctccatgtgcactggcttttccctctttagccggacatccttttccaattctggttttcacttcaataaaggccggcttttgagataccctagcttgatttatcgcacttaatatttcgtcaagatcgtctccatcttcaaccgtgaatgtatcaaaaccaaatgccttcattcttccctgaacatcttctctaaaggcaatatccgtgcttccttcaatcgaaatattatttgaatcgtataaaacgatcagtttctccagttttaaagtgcctgcaagtgaaaatgcctctgacgagattccttccatcagacagccgtcaccgcctagtacataagtaaagctgtcaaatactggatatcccggtctattaaaaatcgctgccaagtgtgcctgggccattgccattcctgttgccatagccatccctgctcccaatggtcctgtcgttgcctcgacccctacagtatgtccgtattcaggatgccccggagtcagtgaatcaagctgtctaaactgtcttagatcctctatcgttaatccatagttatacaaatgaagcagactataaagcagtgatgatccatgtcctcccgacaagataaagcgatcccggttgacccacttccgatgtgttccactatgtttcatgacctttccccataagatataggccgccgccgctgaacccaaaggcagtcccggatgtcctgaatttgccttttcaacagtatcagcgcataatgctctaatggtactgactgtttttctatcaactgcttccatattagcctccaaatactgctcgatagtctttttggaatttttcaatcccctcagcagtcaaaggatgtttcagcatttgttcaataacactgtaaggaacagttgccagatccgctccggctttagcacattcgataacatgacaggcgtttctgacactggctgagatgatctgcgctttgatatcatgcgttttgaatattgcggcaatatctctgatcagctgcagtccgtccatcgagatatcatcgattcttccaacaaatggagaaacataggttgctccggctctggctgccaggattgcctgcggaacattaaaaatcaatgtcagatttgttttgatcccttcaccggacagtacccggcatgccttcaagccctcagcagtagttggaagcttaacaaccatattcttatggatttttgcaatttcccggccttctttgatcatgccttcagcatcaacagttgtggctttgacttctccgctgataggaccgtcaacaattgcagcaatctccttaattacctcattaaagtctcgaccttctttagcaataatagagggattggtagtaacaccgcaaataacccccatatcatttgctttttttatttcttcgacattagccgtatctaaaaaaaatctcattttatttttctccttatatatattgtgataacacttctttttcacattcattaataacttttataatattattctggttattacatgattccagcttttcaatcagctttgcatcattgaccattcgcattaatttaacaattgcaggaatatgttcttttttatctttactcgctaaacaaaagataaccctaacttgtttattatcgaaccatacgggttcatcagttacaatcagactcattgaacttattttaaccgatgatgtgttcccactatgaaataacgcaaatttactatctgttacagcataaaaccctgattccttaatgacactcatcaagccttcataatattcagatttaatacatccatgttgtattaaaatatcagttgaaagtttgattgcatctttccaattgctaaatgatttaacataacgaatacaattttcacctaataaatcacttatattatagtatttcttaggaatcctaacatctttatagccaagttcttctttaattatttcaagtactttttcacgctcaggagaatttaaaaatcccaatcttttttcaattgcaatataattcgttaaaacattcttttttctaattcccaccgcttctaatttattatgatcatgattatcaaaaattgcatttacaacaatcaaagttttttttactgggaggattaactttgacgttgaaataacaatatctatttgctcccatttctgataatgctctagatcatacgctggaatactatcaatcacttgaacctgatattcatttcttagagtatcttttaaaagtgctgtagcgccaaaacctaagccacatattagtaaaatatttttatagtcatttgctcttaatctttgaatacttgcaataaaatgaatagtaatataaattaattcttcttgactgatctcttgtaacggttgaatactcaatacaattgattttaaaacttcaaatacatattcataactttgtggaatcactgtttgacttaactcataaactcgaatattattttttattcgttccaacatcggtgccacatgattcaataatccttttattaaaatcatatcccgtaaaaaaaatactcctaactcatcagacatcattgtcacaagttgaattataatatcttcagtcattattaaatccaaattgatatcaacctcaccatatttattagtataactagaataactcataattagttttttttgattatcatctaattgtttattaattatcatttccagttcttggagtgaataatcttctacatcaatttttttaggacaagatggcaattgcttctcttttataatataccagcaagtagttaatatatttgctacataccaatcaaacgaatcatcactaaaagtccaactcatcattttcattttattagtgatccagtcataaatatgaagaatatcaaaattatagattctatataacaatttcattaattctaattcaaatgtattatattcagaaagtttattactaaataaatagatatatttttttaactcattgacccttaaaggatatcccttatgatcatcttcaattaaatgaaaatgacgattatagactagcgatagaccatactgattaaattctttaataagagtatccaaatcattttgaattgaacgacgcgatacttgaaatttttcacttaactttttaatatttagactatgaacatcaaacataataataaaacgtaataattgcatcctctcatcagctgaaaaaataaattcactatcttctaataaaatatttaaatctaaatcaattgggacaattaattgtcctttagaacgcttttcaatttcagacaatccttttaaactcaaagcatcgttaatacaatctatgtcgtaacgtacattacgttctttaagatctaaagcattgccgatttctttataactagattcttttttttgatttaaaaatctaataattttaaacattctagcactaatcatcccaatttcctccgtttatttttcttctttttctgctatatctaaatttggctttgtaaaatgtaagattgctgcggatactaatactcctaccagcatcgctaatacataccataatttgccattgactactggtaaaataatcaaaccaccatgaggaactaatgcttcgactccattcatcatccctagtgccccacctactgcactaccaataataattgctggtaaaactcttttcatatcttttaccgcaaaaggaatcgctgcttcagtaattccaatcgttcccatgaataatgccgatattcctaaattcttatcatctgcactatattttttacgatcaataaaagtagataaagctaatgctaatggcggaattgcacaagcaattcgatgagcaccatttggagcataaacaccttctgccatcaacgcaagagtaaatgccgttgccgtcttattaattggtccacccatatcaactgctgtcattgcaccaatgattgcacctaagagaactgcatttcctccttgcattccacttaaaaatttaacaagccagtccatacaagctccaatcggaacagaaataacgtaaatatagataattcctaaaataaatgttgtaaaaataggaacaattaaaataggcatgattgttttaatcgtatttgaaactttccatgttttacaccaacgaactaaataaccagttgctaaccctaaaatcattgcgcctaagaatcctgttttaacctctgattcaccaattggattatttgctacatatcctaagatcatccctggagctatcccaggttttccagccaatgaataagcgatatacccagataaaattggaatcatcatagcaaaaccagctgatcctaaatcatttaaatttttcatgaaaggattagttacttccattccagtatccgttgctgtccctgttgctaaagcaaccgctaatagaatcccaccaaccacaactgaaggaagcatatacgaaaccccagtattaaaggctttttgaatatctttccatactttattatttttcataacttcttctcctataagttttctgcttgatctataaccctaacggcatctttaattacatccccaggttcgacttgaattactttaccagcatcttgtttttcttcaaaacgttcttcaccatcgatccccactgcaattgccaaaataacagcatccgcttcatcaatttcctcttgttctaattcgttttcaatccccatacttccttgagtttctacttttacttcgtaaccacgattacgacattctttttcaattgcttcttgagccatgtacgtatgcgcaataccggttgggcatgctgtaactgcaacaattttcatattcatttcctcctataattgttcattgattgcatttaatgcacgatatgcatcttcaacatcttctacttcaatcaattgctttctaaaattatcatctaaaagtcttctacttaataaagaaataaatttaagatgaatattattttgattatcttggggcacgcctataaggaaaatcaattggactgattgtttctcatcatgattccaatgaaatgcatcctttatttgaacaaatccaataaaagcacgattaacagtatgactaattccatgaggaattgcaatttggtaaccaattgaagttgaagccatttcttctcgtttataaaccgcttctttaaaatcttttttactattaattaaatctagtttaatagcctgatctgataataattcaataacatcatctttagtcgataaagcttgctttaagaagaccatttccttatgaattgctttttcctgcataatcattccccttatccttttttacaagcaagcatctttgatgttaatccttccatattaaaacatctaacatgtttttgcatttcttcttttagtttttcaataacaaatctttttccatcaattttaatgcttgctaagttttcatataatttattaatttctaatgctactttaggtttagaataagtataatgaccgcataattctgtaatttgtaatgttgtttgctcatctaaattatctaaatccgacatatctacttcatcagtaagccattttttccatttcattgaatgaattgattcatacttaataacattttctaaatttgatggctctttaatcatattaaatttagcaaactgtttttctacttcaattaactctaataaagccatcgtttcaatcgttccaaaagctggagcaacattcattgctgtgatatttaaaggtaaatgtgctagtaatttagcttcacttaaataatcaccattatgttcctttaatcctactccatatttagttgatattgcacttaattctaaagaattttcataactgaaattcccaacatttttagttaaacgtgttaacgttccagtttgaccaacgataaaaattggcattggtaaatcatgttcttgagtataagattcaattctttggataaaattttcatagcgatccatcgaagttaaaccaccacttgtttcttctgtccctacttcatatgcaatttcacgttcaattccatattcttttctaacttgctcacaatactcaattaattctatagtacgattaaagacaacatctatatccactactttacaatattcatcaggatccttagttggatcaatatgtaataaatcaaaaccatttaaaatatcttctttatatgactctttggcaattgccatagcttcatcttccggtaaatgatctgctctttctttatctctttgccatggtccaccatgatcacggcataaataatagacattatcataattaatttcttgcgcaatctcttcgattttttctttgaataacttttgatcactgttgaatacatatccaccaccaaatttatatgcatcaacttgattacgacttgcaatatacattaatggaaaatctttttcttttgaaatttctaaagatgcccgtaaaaaattttcagacataggtccaatcccaagtaatgtatgtttttctccttttgaattaattacataattaactgcttctctaattgtaacttttttattcatttttatcttctcctcatcatttagcaattaatcaaatgtcgacttttgatttatgagataggtatttgtttctatctacacatatatcatattcaattagtcacaatgacataagataaaacaaatgaaagaaaaagttacaaaaattgcaccctattgttgattaagaaaaaatagaatttaaactcaactagagcataaattctatttttttaaatcagcatcgctgctaataataaataattaatttttcttcatataaaactactatcttttaatcttgatgacataataatagcgtacctaataacatatattcttggagataatcaattaaaacaatttcaggaatataatctttaggaatatatttagctacctcttttttcaattcttcaatattagtaattaaaaaacaacatataacaataatttgcggatctaaaaaactgattattgatgtaacagttttagccattgcttcaatggctccttctggtgtttgatgtaattctaaaacatcttttgaatatgataatggcaaatattgtatttctccagctacatgatggtgtccagcaatcaaacgatcatttacaatatgtcctgcccctgagttcgaactaaccggttgaaaaacaaatgacagtgatgaacagttttctttagaactataatagcctaaagcaattgtattagcatcattactaaaaacaaatttttgcgaatatttcaaagtaaaatcatgagtaattgaaattttctctagcccctttatactcattgagataatctgatcaccacgtataattcccggagtcgataatccaataactttaatatctacatatttagccagcatgctatcgattacatcataataatcttggattgataaagtaggtttgataatttcattattttctaaaatactattattttcatcatataaacggtacacaatatgaacacgattactattcctaattaaagcaagacacaatgttttaacaccactaggctgcatatttttagctttcaacggtttatgcattccttttgccaaggttcgtttataattacgctcctcttcaataatcgataacatcttttttacatcatatttagcaaatatagcaggcgggatatttaaaacgattttattttttaaaatctcacatacctttgcatacatatatgagatttgtggtgccaacataatcatgtcataatcttcactagccttataaagattattatagctaaccgcagacacttgaacatcgatattaagtaactttgttatttgattgatccgatcagcaaaataacctgtcgttaacccactagtacaacaaagtaaaacttttaaagctggtttatttgttaattgcttgatcgtttctaacatttcatcaaataattgaatcgcatgtttgatatttttaatttggaaatggagataaaattcaacttctttttttattaaattttcaaccgaaaattcaactatattcatattataaaaattaacctggctagtactatatttattcttaatagcaatcgttttataatcatccgatagacttatagctaaatttttattactttgcattaagatccactgtttaaatacctctatataaatttcactcaagaattcatccattttttcactcctttatcttctaatgattttaatagtccctgattatacatacctttattatattataaaattcatagaaaagagaccaattgccgttattctgataataatttttcaatttaatataaaaaaaggataaaaagaaataaatttctttttaatctccaatttaatctttataaaaatcataattaaacattaattttggcaactattaaaagaaacaaagctaccgccttgtttctctttattcctacataaccgtgataatcgactttccagccgttacttcaccatatttttctaattttaatgtttttcctttagtatctagaaaaacaatcataattgtatagtcaatattttcatttcttaaataattaagatctagtttaataattttttcaccagctccaactttttgatttttcttttttaatattgtaaatccttttccttttaaattaacggtatctagtccaatatgaaccaagatttcaacaccgtcatctcgtgtaattccaaaagcatgaccagtaggaaataatgtcgttaatactcctgcgcaaggggcacagacctctgacgaggtcggaacaatagcaaccccttctcccattactttttttgcaaatacattgtcatcaacatattcaagattaaaactgactccatttacaactgcatatacattatttgtatttttttgattattttttaatgatttaaatatctttatcatagtattaactcctaaatttgctaatgactattttgttggaagtttttattttttactggaacatcttcaaatcctgagaaataactcaccacactagatacaacaaatgccgcaataattgcgataatgacgccaataatcgtttccccataaataggaagtgccaaaatactaggattaccataagcaaatgcctttactccaaaaaatccagcaatacaaccgccaactgcaccaccagccataacaccatacattggcttttttagacgcagattgattccgtagatagccggctctgataccccggctagaatagccccgacaccactactaatcgcttgtgaacgtaattctggattcttagtttttagtgctaccccaaaacaagctcctccctcagcaacattatgaacaaattgtgttggccttaaaaaaccttcataacctaatgatgcaatactttgcatcattacagggccaaaaacagtatgcattcctgacattattacaaatggcaatacaccaccgagagctccaagcgcaaatggaccaatcgtactttgcatccaaactaagaaattaataaaatattcaccagcaaaaaaaccaattgggcctaatacagtaagggttaaaagacttgcaagaacaagcgttaatccaccaacaaaaattcctttaaacattcccggtaaatacttattcaaaagcttttcaatatttgcaactgctacagttgataatattgctggtaaaaaagatgaagcataacttgctgaataagctgtgaagcctaatatttttaagggctcttctgcacttaacatcccaataatatctggatggatcagtagacaagctactatcattgaataaataggtgtacttcctaatctgattgctgcaccgtatgctacaaaaacaggcataaagtagaaagaagtattaacaataccatttataactagatatgtttgattatcaacaatttccggccacgctaatgaggttagtaccaaaaatacttttattaatccagctacagtaagcccaggaatcattggtgtaacacatgcagataagaaattgaaaatattttttattcctcttttccaaattggcgaatcatctttttctttaatatcttcatccaaaatttcatcaataatttctgctacttcaaaattataatttttaactacttgagtaaatgtcgcagataaatttttccccataattatttgaaattgaccggcaccaaaggttgagcccaacactccatcaatttcattaatcttatcttgattaactagatttttattttttaatacaaatcgtaatcttgtaacacagtgggttacatatttaacattatcctgtccgccaatcgttataatgatttgatcggctatttctttataatccatattattctcctctatattattcttgaaatatgtactaataaataaaatcgttccgcctctgatagtacataatcaaattcttcatttaaatatctttcgattgaatctaacgtaatacctatttttttattaatatctgacttagcacttattattaatttttcaaaattctcatcatcactttcaccctttatcacccgctgcataaaaaatttaagatgaatcactagcctagaataatacagtgaatcttcctgtagttcaagaccaagattagcttcaattatatttaaaatatcatctatgctctttaaaatactcgttgttttgcttacattattattaaactcagcattaattaagtgaaatgctatagcacttgcctcttttttatttaaatttatttgataatatctattaatcaaatctaatgctttaaggccgacttcatattcttcatgatagaatctttttatttcttcactaactaaactataactaccataaccctttagataatttttggaaacaaagttaatatggtctgatagcgatactaataatccttgattaaaatttctatttaaatcagtttttgccatatctataatttcttgggtcaattcaatacatttaaatggaatttcattcagtaaggctttaaattgaattttcaataaattattttgtaacgtataaagcttgtaattttctttcattgttatataatcattaactttatgattaaatcctacgccattaccgataataattatttctgttccattttctaatatttcaatggcattattatttaagattttattaattctatagtatttatttttcatatctaatcctctacatttattaaaatgttaaatcagacccgtttgttttaattaccttcttataccaataaaatgaatcttttctataacgctgtaatgatccttgtccataatcattcatatcaacatatacaaaaccatagcgtttcttcatttgtccactagctaaagatattagatctgtacatccccacatagtgtatccaaaacatggtactttatcaatgacaatagcatctctcaattgttttaaatgttcagccacatattttattctgtaataatcatgaatttttccattttctaaaatatctactgctcccattccattttcaataacaaataatggtttttgataacgatcataaatttcatttaaacaatagcgtatacctaatggatctattcctgcaccccattgggtcttttttaaatacggattgggttccccacccatatgatcaactttagaaccagcactaacaattgaagaacgataataactaaatgaaataaaatctaaagtatgttttttaatcaagtttcgatcttcctcacttactttcaatttgacatctttcttattaaaaatatcttttgtataatttgaatatgacccgcgagccattacatcaacgaaaaataatgcttcacgtcgcttacaataagtggcaaaaacatcttcaggattacatgtagctggataaatttcgcttaatgcaaacattgctccgaattttatgtctcccataattttctttccctgactaattgctttagcacttgctacaaacatatgatgaactgcttgatatctcgtctgactatcttgtttatgggttcccatttgagcgtacccacctaaattatttatttcattaaaagtaatccaatatcttactttatctttaaatcggttaaatagtgttgttgcataatttacatagcatccaatcgtttctcgccccgcccaaccatcatataattcacataaatgaaagggtacttcatcatgacaaattgtaatcattggttcgatattatattttaaaagttcatcaattatcatttcataaaatttcaaaccatcttcatttgctttttcttcatcaccatttggaaaaattcgactccatgaaatagaaaaacgataaactttaaatcccatttctgcaaacaaagcaatatcttctttccaatgatgatagaaatcagtcgcttgatggctcggataatatatatcatcataaatatacggtatagctccatcgggaattgagtctcgataatcaatactccccctcgttccattatttaattttaaagtaatttgtctttctttatctatgtcaccagcagtttcaaaatcatgactcgataagcctcttcctttttctttatatccaccttcatattgaaaacaggctgtagcacctccccataagaaatcttttggaaacctgatcattttcttacctctcttcctctctaatttgccaatataaaaagggcaataccaaaaagaagctaaattcttttttggtattgccccttgtttttcccgggtaacaagccatatttaattgacacttatattttatcatataatttattttttgcaagggctttcaaaaaataaaactatttacaatattttgcttattaaaagtaaaagcacaaacacataggtaaagagactaagtaaaacagctccaatgtatctaattatcaaaataccagtgagagtaaatattccttttttgaatttggaatttctatcctcataatcattagaataaagtcaatcaaataaatatctaaagctattgatgaaaacaatgttttaaaaagatttgattctaaagtgattttctccatttacaacatagtcacttatcacatagatgctaccagcaccataaagattgctccaatattaaaagtacttaaataagttactgtcaaagatggcattatcgcttgaataaacggcaaaacaaaccttccaatgttatatacagaagcatttaacatagagacacctttcattgttttggaatctcttaatttaacatgatagccaacaaccgccataattatattatttaaaatttctagaataataaaaagcatgatatttgatatcaatcgaatctcacggttcccgcaagcaatgtccatggacatgtaatgtttgttataagtaaagcaagaacatacgaatcactttctttaatatatcctcttaattttataaaacatgctaaaaagataatcaaaataaataccattgcttgttgtattactgacgtcataaatttttatcttctattcttttgtaattagtatgcttatacttgatgtatcgattttaataattcaatacccgtttttgttttaaatattttttctataaaatttcttatatcttcaacggaataattgctgctgtttcaagagcttttaagtcttgctgattcagttttactaattcaccaatgttttagcataagcatgcacttttaagaaatgtttaatgttatagttatttccattagcatatttaatcattttatttgcaatattataaatcatcacaatccttcttaatctaataattaatcctaataaaagaataatcttcatatctattaaaataaagattttttatattctcacttattttcattatttaataaaaaaagcgcaactaaattacgctctaaacttttatatctttgatagcagtacgattgtctcaacatgactagtatgtgggaacatgtcaaccggatacattacctcaccacgatagccaatttttgcaaaatacttgatgtcccttacctgagtacttggatcacaagaaatataaacaacttgtttaggattcaagatttttacagcatccataaattcctgcgtactgccactgcgtgggggatccataattacacaatcaactttttgcttctgtttagctaatttaatcataaaagcagaagcatcatcattaataaatttaatattttcaatcttattcattttagcattattgatggcatctttaactgcatctttatttaattccacaccagtaacttccttagttctattagctacaatcattccaattgtcccaattccacaataagcatctataattctttcttgacctgttaaattcaataaatctagagctttagaatacagtaattcacactgttgatgattaatttgataaaatgattttggcgaaatcttaaacttcaaaccacacaattcatcaactataaatcccttaccataaagaatcttttcttcattacctaaaaccacactcgttttacgtttatttacatttaatacaaccgtcttaatacttggaaaatttttaatcaactcattacaaaaatttttggatcctttaaatacattatcattgcaaactagtactaccattgtctgatcagtaacaagagcacgtcgaattaatacatgacgcaataatccgcgattacgattttcatcataaatactaactcgatatcgttttaataagctttgaatcttcttaataatcatatcactgagttcttcatgaagaagacaacgatcataaggaataatcttatgactatcctcctcataaaagccaaattcatatctatgattaaaagcaacaattattttattacggtattcataaggatgccccattccaatagtatccttgacttcatacatgtctaatttattatcttttaacagcttcttacaataatctgttttaatctttaattgtctctggtaatcagtattaatgtatttacagctaccacatttcttctctattaaacatttcattttatcacctagcaacagtataacataactaaagcaaaatactaatcaattccttctctcattattatttcttcataaataaaaacaaggtatagtttgttaccaaactatacctactattaatcttcagatatctcttcttcaatgtgccctactacttgaaatgacttatcagtatactgcataatttcaaatttattaccatcaggatcatgcacccacatttgataggtatgtgatggacctttagaaataggtgtatctattgcaactccacattcaactagttctcgataagttttttctatatcctcaaccaataacgcaaagtgtgaataccccagcctctggttccactcatcatgtggcgcttgtccttcatcctttggaaatagttcaataaactgtccaggggcaatttcaatataaacaatgataattctgtttggatcaacttcagctacttcactatatttaccacgatttagtcctttataaagtcccgcccttgttacaattttaacttttaatcctaacttattttcataaaagtctctcatcacatccatttgatcagtgaaaaaagatacatgcatcaagcttttaaattccatttgtcttctcctttaattatcatttgtaaatactattttttcttgatttcttgcctcattcatgactttagctactattaaacttaattccagcatctttttagcaaaatcataatcattattatcaatgattctaataaattcaataaattcataatataagcgatgttcacaatcatcaactcgataaatttcttcagtgccatcgttaaaaataatttgatatccggtcatctgattaacaggtttatcaattttaataacccctttatcaccttgaatcgttgaaataatcggtgctttgcaatctttagcccctatacttatccccttaaacgaaccataatcgtacattagaataccacttgtatcaatttgattctcaatatttgccatatacccaatacttactggttgaccaaataaacttattattgcattaacattataaacattgatatccatcaaagctccacctgatttatgataatcaaatgccggtaaaattgttccttgtttaaaagcatcatatcgtgaagaatattgactataattaaaattcatgattttaatatttccaattctctttatatcttctttcaattttttaaaagcaggtaaataatggatattaactgcttctaaaataattagatcgttttcttgagcaatttcttttaattcttccaattccttaacatttgaagtaataggtttttccattattacatgcttaccttttaataaagcttttttagcaaaactaaaatgtaaatgatttggcaaggcaacatacactgtatcgatttcacttcgcaacatttcatcatagtcataataacaatgatctagatgatattgcttagcgagaatagtagtctctttcttagtttgttcagtccctaaaatcgaaattgattcaatctttaacttatttatagttgttaataagtctttaacaatcatccctgttcctaaaatacctaatttcatttaatttgcctccctaattatttctgttaattccaatatcctttttgtatcttccaaactatgaagtgcactctcagttttatgagctcgtacatcatcaataaagcactgaatctccatagtcatatcatctccaataattggataattgcgttcaaccacagtaccatcattttttatgattttataatcaataatacgattaaacattggaatctctatttttccaaattcaccttcgataattgctaaacgctctttattacgatcaattgccccttccacaatcgcagtacattcattattaaaattaatttttgctttaaaataccattcaactccagcaacaatatcaatctgtgaattaacattctttatatctgaatccaccaaagctaatacaaaaccaagcaaataacttcctacgtcattcagtgtcccaccttgatcaacgttaaataaatatgaggtagtttggtgagcagtagcatcaaaacaaaaattagcttcaatttgtttgattttaccaatcaatgataaatcctgttttaaatgttctaaaccaatattaaatttagtctttaatgcttctaagcaatatcctttttccgtatatacttttgttttaatctcctcaatatctgcaactgtcaataccattggtttttctgataataccgcaatatgattatcaagtgcttttaagatccattccttatgatatttatgaggtaaggcaatgtatacagcatcaagttctcgatcctgtaataattcgtcataatcttgatatattttaacttctgggtgagcctttacatattcatcatcacttgttaaggaatgagatgcaattgcataaatctttccttcgtcagtgtattcaatacttttaacaaattttcttgcaatattcccaaatccaataattccaaaattcattgattttgcctccttttccttgttataacataactatttattatttaaatatatttataatattctggaaacaaagtactaagaaaataaaaaaaatactgtgatttttgtacttttagtacaatcacaatacttttatataaccgtcataatataattgacccataaccagctaattggcataacaataaccattgcaggaatcatatccgcaattggaaattctttaaccttgatcattctaaatcctgtagcaatcattaaaaagccaccacaagctttaaaatcattgatcattgctggtgtagtcaatggaaaaataaactttgctgataaaaataaaataaaaaagattacaaactgcggaatggcaattacagataccacataccctaaattacaagcaaaaatcgcagcagtaaaaaaatcaagaattgatttagaaatcaaaactccattatcacccgtcattcctgaagttaaggagccataaattcctgttccactagcacaaaataacacaataatagtaattaaagtagattgaaactcttccgaacttaaatcactaccattatttttaaatattttggcaattggcttttgcattaaaattgctcccttattgatccaatcactaaagtgcagtgataatcccacaatagttccaataattattgaaaagattactgccggcatattttccattaatccaattgcattgattcccatagccatagcacaaatcccaaaaatcaaggttatttctgtcttaagtctatgacttaatttatgacctaataatgcaccaaatattccccctaatacaattgataaactattaataatgactcctgttggcattatttttccccctttataatttgaaaattatttctctaaaagattccattcactctctttataaagaatatcatttttattagataattgccaattaaaatagtttcttgtcttattaagaaaaaaaaggacataattctataggctacaatatttgaaccataaaatacatgatgttataatataaagacaaaaaggagatgaactatatgacaaaagtagatattatatctggtttccttggagctggtaaaactacattcataaaaaaattaattagtgatgtatatccaggagaacaaattgtcttaattgaaaatgaatttggtgaaattggaattgatggaacttttatgaataatgctggaattgaagtaactgaaattaattcagggtgtatttgttgcagtctagttggtgactttgaagcttcattaaaagaagtattagaaacatatcatcctgatcgaattatcatcgaaccttctggtgttggaaaattgtcagatgtaattaaagctgttagtgatgtacatagtcatgaattagaacttgataattatattgctgttatcgatgctaaaaaatgtcgattatacacaaagaattttggagagttttttaataatcaaatcgagtacgcctcacttattattttaagccgaactcaagatataacagaatttcagctagatgagtgtttaaaaattattaaagaacataataatcaagctaatgtcattacaaccccatgggatcagcttaccaaagaaatactaattaatgcctttagtaatagtgataatcttcgtgatgaattgttggaacaattagatatttgtcctatatgtgcccatcatcatgatcatcaccacgatcatgaacatcatcatgatcacgaacatcatcatgatcataattgtgagtgtggtcatgagcaccatcatgctgatgaagttttcaccagttggggtaaacagacacctaaaaaatattctaaatctcaattagaaaaaatcttaaaagaactaagtgacagttccgcctatggaaatattttaagagctaaaggatatgtcgatagtattgaaggtgattggtggtattttgatttagtccctggagaatatgaaattcgtataggaaaacctgactttacaggtcgaatttgtgtcattggcgaaaaattagataaaataaaattagatagattattcgatgaggtcgcttaatggaaacaagagtatatattttcgcaggctttctagatagtggtaaaacctcatttattaatgatactttaatgaatcctgacttttatagtgaagaagacaccttattaattagttttgaagaaggtgaagttgcctataatgatatttatttaaaaaaatctaatacttcattggtaacattagattttgaaaattttaccacctatgatctaaaacatttagaattagaatatcgtcctactcaaatcatgattgaagctaatggaatgatggacctgaatatttttgtaaaagaaacgattcctgaaaactggaaagtggtccaagtattaacaacttttgatactactactttttcaatgtatttaaataatatgcgttctcttgtatatagtcaggttgtctttagtgatcttgttatttttaatcgctacgatccaaatattaaaaaatccatgttaagaaataatattaaagcgattaacagtaatgctcaaatcatttatgaattagctaacggcactatagatacaatgaatcctgaagaagaattaccatttgatattaataaagaacatttagatatacaagatcatgattttggaatcttttgtatggacgctatggatcatcctgataaatataatggtaaaacagtcaaaattaaaggtaagtttatcggtctagatcgtgtcattgaagatggttttgtcctagggcgtcaagctatggtatgctgtgaagaagatacctcattgattgggcttgtctgtattagtaagctagcaaataaattgattcctgaagaatggatcgttgttgaaggaaaaattacagttgattatgatccggaatatcaaatgaatgttcctatattaacagtggagcacctcgatgtagtccctccattaaaaaaccaatatgtgacatttgattaaaaataaagatgcctgctttattataaaaaagcagacatctttattattttccaagtttttcaactatttgaactactaattcttgaccattcatctgaccataaacgaatggatcaattacttcgatcggtttttctggcaataattccttaactcgatacaaatcatgttttatttgaggagcaataaaaatataatcagcatatttccccaattcattaatttttaagattggataagcatatacttcataattatacccctcttgactaatataccttttcatacaattaactaaaatacttgttgaaactccctgtgcacaaaagatatatatccgcttcattattcagcctgcaaattattttcttcatcaagacatttcttatcgtatactttgatgaatggataccaaataaggccagatacaatgaacattacaacaaagataagcaccgcacgccaatctaaagtacacaagtattggaaaaacggcatcggaatattagaactagcagcaattacagctttacccataatgccaaaattcatacagcaccaaattattcccatattgattgtgtaaaaagcaatccatggaattcctaaaattggattaaacataattggagctccatattgaattggttccgcaatattaaaaattgctggaacaatcgatattttccccattgatcttaatcgctcacttttacattttaagaataatagaggaattatgtaacaaaatactccagacatttggaacattggtaaagtgaatatttttgtagcagtttctccggctgcataagcagcagcattagcacctgtattggcaatcaataacggaagaattattccagatacaacattaaacccatgtactcccaagaattgtaaaaatgcaataataaatgccatcaacatacagaaccataatgattcagaaccttgaatcgccggtgttaataaactcattatccaagacggtaatagcatccctgtgaaattttgacaaagtaaagataatccatagaaaccagcaacgatcaagcacatcggaataatcgcatcaaatgaagcagctactgctggaggaacactatcaggtaatttaatttgaatattacgtctctttagtaattgcatgatttccacggttaccaaagcaacaaaaattgctaaaaagattccttgtgatcctagataagttgcatccatattattatcaacaattggtgctgccaaaacaataaatgataacagcgatacaatcggcgcttgtaataaatcaagtttatatgttcgtgcatggtaataagcgatagcgcatactgcaatgactccaaataaaccgaaaaccatattatacgggaataaaattgcatcctttatcgtctcactataactaggtatgaatggaaatatatctggtaatgctgaaataagctggaaaatactcccaaaaatcgttaatggcattattgccattaatccaaaactaatcgattgcaaatgcctttgtgttgctaacttattgcccacttcaataagtttatcttgtaattttttcattttattttcctcctatatatttgctgcaataaaatacgcatcattagttgctccaactacttgtcctaacttttcacaatcaccaaacatcatcgtttcatcagctattccatacaatttaaaagcttcctcacgatttggtttcattccaacagcaattatggcattatcacatttaataatagattcgccatttttatttattattttaactccgctttcactaaatcctaagcattgactatttattaaaatggtcaactgtttttcaaatcgttttaacaaacgccttaatcctgctcgatataaaatatgcccttgactagctatttggtcagtcatttctattactgttactaattttccacgttctaataactctactgctaactctattccaacttgtcctccgccgacaatacaaacattatcttttaaagaatccaatttaggataaacgttttcaaaataatcaacatattctaattgttcccctgggaaatggaggcgaattggtgaagctccaatggcaacaagcaccacatcaccatttagttgctctaataaatttttagtagcggtcgttttatacataacttgaatatctcgcttgttaatttggttttctagataatctcgatatgcttttaattcctgtttatgcatttcatgttgggccaaatttaattgtccccccaatttatcacgttgttcaatcaaaataacttgatgtccccgatcatgtgcagttattgcagctttacaaccagcaggaccaccaccaacgacaatcacttttttaataatctcacttttttctaactttaatggtacccgatgttcccgacgatatcgagggtttacagagcattgtacatttgtatgttctgtagcactatgatagcattgtaaacagcgaatacatggtacaatatcatcgatttgcccctgcattgcctttcgtggtaaaaatggatctgcgactagaggtctacccattgaaataatatcaactacaccttcttgtaataattgctcagcttcttttggcgtcattattgaaccaattacaccgactagtttattaggaaagttttgtttaactaattttgcccaatgaacattagttagatgcggttcaaaaatactttgacaatgtttcccattaacactataccaagcttccaatcctaattcaggctctattatttgctcttctggaaaatatcctggaatcatatccatcccagctgatacattgatcaaatcaacatcatcttcgattctttttaataattccaacatttcttcaaattggtaagacccttttaaataatcactcgctcctaacaatataacaattggaaagtctgtgccaacagcattacgaatcgttttaacgtgctctattgtaaagcgcatacgattttctaacgaacccccatattcatctgttcttttattaaatactggagataaaaactgggttgttaattcttcatatccaacgtacaaatagataaaatcaaaaccaaatcgtttgattgccaatgcatcatttcttgcctgtttcataatttcctgaatatcttcaagcgttaattcaactgcacgagcgccacttcttgttaaatatggtgatggtgctaaaacctgcttaccatcataatgagctcgaatatcattagctgcatcttgttttagtcgtggtacacaccaagttccaaccttagccccatactgacgggctactgaaatagattcacgaataccatcgcgatcatgttttggaaattcaccattgtcattagccgcagattcaattgatacaaaagtcattgctgctccacctacagacttatctataatactaacatttccatagtgagtcgtagataataattcatggctcttgggaatccccatcgttgatgcaataattctatttttcaacatcattgtattaactcttaatggttgaaataaatgtggataatactgattcattttctaactcctccttgctctcttattgtatgtcaaataacttttgcttccaaaccagcttttgccacgatcatggcaaaagctgaatcacaattttaagatttctatcaagaagtttgttataatatgataaaggagtgattattttgcttgaacttacctctagacaatttttaattattcgtctattacaaaaaaataccgttccactaagtgctaatacgctatcaagattactagatattagtcctagaacacttagaaacgatatttttcaaattaataaaaatattgaggattttcatatttcttcatccaaaaatggctatcaattaactttattaagcgaaaatgcccatatgcttataaatgatattaaaatatccgaacaatcaaagtctaccaatataattttacaatatctgcttaatcacccatcatgtcacttattagagttatcagaaaattgttatatgagtgaatccagtgttgctcgctgtattaaaacaatcaaaccgcttttaaacaaatatcatctaacagttgaacgaaaaaatgatattttttcgttacatggtagtgaatatgataaaagagctctttttgctcatttaattgggattgaagcttcacaaccaataactagcctacaacactttcaacagtattttcaagattttcatctttctgaaatagaagctataatcgactctgttttaaagaaatataatattcgagttgacgatattcactatcaaaatcttgtgatgaatacatctatcacgcttcaaagaatttttgttggaagcgacatcgaacccctgccgttttcatactccttatctaatgacgaaattatttgccagctgtccaaagacctatgtcataacctagaagaatattttaatcttcattttgctcaaacagataatgaatatatgcaagtcctttgtattggctcgattaaaataaacgaagaaaattatgaaacccaaattttatataatgattatagttttgtttataaaattaaagaaattctcgatgatcttgttgaacacttttcattgcaacttaattatcaaatgtctttaaatcattttgctttacatattcatcgtttattttttagaaatcattcttcgctttactttcaaaatgacttccataataaccttaaaaatacccatcctttcatttatgagttagctgtttattttgcctataaatttcaagaaagtttcaatattacagtgaatattaacgaaattggcctattggcaattcatttaggtttaatgattcaatccaatgaagaaaataaacaatatttaaaagcactatgtatttgtccaaagtataatgatttacgaaagcattttgccaatcaatttttattaaactttggtgataatgtacaattaattagttttatttcttctaaaaagaatattcaagactatcattttgattttttgatttctactattaatgactatgaaagccccgattgtatggtaatcagccccttgctattatcacaagatattgataaattgaatcttaaaatcaatctattaaaagagaaaaagaaaaaagatctgctaaaaaaggaattatctaaatacattgatcctaaactcttttttagaaatgttgattttacatgtaaaaaggatgctattttatttttatgcagtcaaatgttaaaacatggtgatgctaaaacagattttgttgatagtgtatttgaacgcgaaaaaatatcaacaacttcattttttaataaatttgcagttcctcatgcaattcattttggtgatgtaaaaacccgaattacttttttattgaatgacaaagcaattccttggggtgatacctccgttcatttagtcatgcttatttcaataaatgaaaaagacataatgactttcaatacaatctattcttcaattattgatcttttattagatgatgagtcttttgatgaaatgttgaaaatcaaaacatttgatgaattatcagtttatttagaaaatcatgtttaaaaaagttgtaatgctttattcattacaactttttaatctttatgcaaagatatttcatttattaaaatattatgttcccgatgatttgaatccacaaaattaactgtaccattttcattcaacttagtaaatgtaactaaaccataatcttgaaattcaacctgtttatcctttaaataagcaatatcattagcataatcaagaattttatcatacgaaccttgctgataaagactatagtatatcttaaaatatgttaacattgctatcattagtgatttaacttgatatgtctggccagttttcatcttcattgaagcataatcaccgtttattgaattaacatttaatccaactccaactacaaccccttctaaatcagtttgatagattgcctctactaagattccacaaatctttaaatcatcaacataaatatcattgggccacttaattttagcttttattccataacgatctagtaaccccgccacactacaagcaactagctgtgtcattttatgaaggtcttgaggttttttaaaatcttttaccaaaatactcatcagcaagtcatcaccattcttactttgccaaacgtgtccattccgaccccgaccatttgtttgataattacaacgaactacacttagattaggaagtttatttaaattacgttttacgtaatcatttgtagaatcgacttcgtctaattcaatataactcataatatcaccccattactatacttctattatattagaaatttaggaaaacaacaaatatttattataaagttttattctaatgcaccctttactttttttctagtgaaacaacgatcttgacgattagctaaagcgctaacccgggcttctagcagtatttttctaccactttcattacgagtataaataacctgataattaccaataaacggcttcatatagccagcaaatatatgcgcatcttcttttcttttagcaaaactatcaggaattgcaaaataacaatctaatttattttttcgtttaggattataaagaatataacgttgattatcaatagatgcaaaaaattcattgatgcatttggcaaacaaagccttatcatgccctgttccccctaataaatatattgcatgtatcgcattaaaagaatctgtttcaacgcgactattcaaagaatccagctgattggttttttctaacgcatttctaattcctttgccaaatatttctaaacgacctaaaggatttgctaatgtataaagttttttgatgctcaaaagaatactcataacaaatattccaacataaattatcaccactagatattctaaaatatctatcaaggtcaatgattttagaaatggtattccaatgacagcaccaataatcccactaaaaacaattatcagtaaagttcttaaagcatccataaacataacgacagttataaattcttctttaacttcagtttcttcaacaatttcaattttgtcatagacagctaacgaatcttcccatcttttctttaattgactacgctttgaagatagtttaagcatatctttattaattttttttatatttcctggactaaatggcaatttaattgcgctaagtcgcaagattccattttcaattatatcctgctgataatgcaaccctaaaaaatgttccattctccttgcaagcgtttgaaaatcttcactaccgccatcatcataatgacccgttaacttttcttttggtctaacacaaactaaatgccaaatattacttgttttattgggcgttttctcaaaaactctaatagctcgtccacgcatttgattacttaacatatatgagcctacaaagctagccaaaataagcgaattaacacacggtgaatcccaaccttctccaagtaaagatttagttcctatcaaaacttgcatataaccctgcgcaaatacctcactgattacccctgttataaaattacggtttccactaatttcaacttttacataatcatctaattttccaatttgatggaagctgattttactaggttcttcaactaattctattaatgctgtttgagcatccttggggataataatcattgtgccacataaaacaccaaatttaattgctgtcttatttttagcactatcacgccttagttgttcaaaaaatggtaaaacgcctaaattattcacatctttgctttcatcacctaatgcccgttcatattcttttcgaatataatcagtaagaatcaaaagtcgtaattcttgtttcatcgttttatattcataattaacaatttctttaatgctttcacatttaccaaccgaatttattagcattttttcaattgcttgatttaaacacaaagaaacttttcgtttttcgattaaacctttagacttcaattcacgaatcaattcatcacggtattgttcttcaactcgatatgaagcaatatcatcatataaaaagccttgcagtaaaatttctaaccatttaagtgataagggttctaacgatttatatcctaaaagcttttgatacttattcgcactgcacactcccttagtatttaaaaaaattatcattgctgataaatagctcggatcatctaatagctcatcatcacttacttcctcagtaaaaaagcgatgactcataatagccttacaaaaatattcatcttgtattagctgcttcaaaatactttgactattttcctcaaagatacttaatttttgtttttcttgagaggccggataattgaaataaacataatcttgatgtggacataaagtaccatctttaactaattctggaactgttatctcttcatcaatatcaccacacatatccatatacctagtccacatgcttagattagaatcatatggcggagttgctgttagagccactgtgaaaatattattaaatgcttttttaaattcttctaatgatttccaccactcacttcgaagatgatgacattcatctagacataaagttcctaattggcattctttaaaattactgattacatcaaaattatgataatcaacttcttcaactgttttaaattcatcattagtctctactagttcaccacaataatgactcatcgcactatgtagtgcctgatatgtcacgacagtaattaattttggtttttttaaatcttgagaaagatattgatcgcgattttcttgtttaactaaaaaagcttcacaaatacgctctacccattgttcacgaatcgttattgatgggactaagattaaagccgagtaatcgattctttttattaattcaattcccaaagttgtttttcctgaaccaggtgcagcaacaatatgaattttacgatcttgactataacggtcatatttatcaagaacacgttgttgataactgcgccaagtgcccttgaaatgcaaaatttgttctaacatccaatccctcctattacctttatttatacatatcaaccttaaaacatcaatacaaatcaacttaattttatgataaaaattctccttccactaaaaaagtagtacaataataatcaaaggtggtgtaattatgacgatgtatattcaaacccaaaatcaatatacccaattccaaagtgatgagttaactgatttacttggtaagattagttttactatcaataaatttggactttggcaaagtaatcacgatactagagcaaattatattactgatgatattgaaattgtctattatcgagaaggtgggtctattacaaccattggcaataaaaaatacacctgcccaccccacagctttctcatcatcgaaccctataagctcaacacttcaataaatactggaaatactaactacagctattatttttttcattttgatattgaacccctatcattgcgccaacaatttattactctcttaacaaaacacgggcatttaatatataaagaagaaataaaagacttcaaagaaatgctagaacgtttattaatcgaagctagtgaaaaagaaattggctattcaagcattataacctctgctttgattcgagttgttgtagagataatccgcgctcagcttaaaaggaataatgaccatatttcacaaataacagatttaccacatatcgaattagttaatgatgccattaagtatattcatgaccatcttcatgaaccaattaaactaaccgcaatggctttacaactaggtgtttcaacaagtatgttatataaatcttttattgcaattttagcaattcctccactaacttatattcatcaacaaaaagttctctatgctcaaagaatgctggctcatggtaaaagtgttacaatgattgcaaatgacctgggatattcatcagcctatcatctatctaaaacttttaaacaaatcacaggggtcagtccacgtgaatataagaaaaatattaagttattataagcatatacgaaaatgtatatgttttttaattgatataatatgttttatatatatgtaagtgctatcatatctttataagggaggtatgaatttggaaaataaatatcaaaaactctttcaaccaataaaaattaatcagctggaagtaaaaaatcgaatttttatgtcaccaatgtcaacaaactttgcaacaaaagatgggtatgttactgatgaaatgatctattactatagcagaagagcaaaaggtggcgttggtctgattgtaactgaagtaacaatgattgagccaacctacaaatatattgctcatactttatcagttcaagatgattcctatcttgaaggatggcaaaaattagctaatgaaattcataagtatgatagtaaggtcgtagcccaactactacacccagcatatatggcaattcctttcccggaaacaccacaattagttggtccaagtgaggttggtccatactatgctaaaactcctccgcgacctttgacaaaagaagaaatcagtataattgttgaacaatttggtgatggtgccttacggttaaaaaaagcaggaatagatggtgttgaaattcatgctgcacacgcacatgcattactaggaggatttttatctccactctataataaacgaattgatgaatacggtggtgacataactcatcgcattcgtctacttttagaagtaattgcaaatgttcgaaaaaaatgtgggcgtgatttcgctattattgttcgtatcagcggtgatgattatgaagccggcggacaatcattacacgaaggatgttatattgctaaaagattagaagctgctcaagttgatatgatccatgtttctgggggaactactatccaccgcggcagctcaattgcaccccctggaacaccacaagcgagtcatattgacagcgcacgagaaataaaaaaatgtgttaatatccctgtttcaaccgtaggacgtttgaatgaaccttggattctcgaagaagttttagaaagagatttagcagacgtatgtatggtaggtcgctcactcttatgtgatcctgattttgttaataagatcaaaaatggtcaagaagatgatattcgtccatgtattggatgcttgggatgtttaagctcgaccatgttaaaagatcatgttgaatgtggaattaatccatcattgacaagtgagaatgaagaaactgtaacacctgcgacaatatcccaaaatatcctagttatcggaggaggtccagctggattagaggcagcttatattttatcaaagcgtggacacaaagttacccttgctgaacgtcatcatacattaggcggcgcaatgatcgttgcaggttatcctattgctaaacagcactttgctcaaactactaaatatttcattaaacgagtaatcgattgtaatatcaaaattgaattaaacacgattgttgatcaagcctatttatcacagcatcattatgatcatatcatcgtcgcaaccggagccaaaccattacgacttgatatttttaaaaatcatcctcatactggtaccggacaagatgtgcttcttggcaaaatgtggacaggtaaaaatattgtcgttgttggaggaggctctgttggctgtgaagttgctgattttgttgccccattagttaatgaccgccatccaaataataaaaaagtaactgttattgaaatgaaatcaaatattattatggatgatacttcaccatcacgaagtattttagttcaacggatggctgataaaggcgtgaacattattactgatagtagagtcgttaaagttacaccaacaactctcgaatatcaaaaagatggcaatactattacaattgaaaatgttgatacaatcattgaagctactggttattatgctgatcatgagttagaaaaaaccctcgatcaaatgcaacttagctacaacgtcttaggtgacgctgcaaccccaggaaaaattaaaaatgctataagtgacgcatatcatttatgtaaaaatatttaatcaaaggagaaaatatatgaatttactaaaacctattaaagttggaaaaattactttaaaaaaccgaattatgtttcccccaatgacaaccgggtatgaagaaagagatggttcaatcggtgaacaaagttttaatttctataaacgtttagcgcaaggcgatgttgcttatattgttttaggtgatgttgctccagtcaatactgtttcccctacacctaaactttttcatgacggtcaaatcgaagctttcaaaaaattaagcgatgccttacatgagtatgattgcaaactagggattcaaatctttcatcctgaatatgatgttgatgctctagcagaattatttagaaaaggtgatatgcaggctgcacgtgctaaattacatcatgacatgctacattatatcgatgaagtaactgaagcccagcttacagcaattattgataaaatcggcgcttgtgttaagcgtgctgccgccgcgggggtggatgttattgaggttcatggtgatcgtcttgtcggttccctttgctcaaccattctaaatcaccgaaatgataattatggtggttcatttgaaaaccgtattcgctttgctctcgaagttgtcaaagtaattaaagaaaatgctccagatatttgcatcgattataaactgccaattatcactgaaaatccgcttcgtggtaaaggaggcctaaaaattgatgaagctattaaattggctactatcttagaggctcatggagttgatatgatccatgttggtcaagccaatcatactggaaatatgaatgataccattcctgcaatgggaactcaaccatactgttttatgaataaatatacaaaacaaattaaagatgttgttacgattccagtgtcttctgttggacgaatccttactccccaaaatggtgaatccttgattgataacgggatttgtgacattattggtttaggtcgttcattattagctgatcctgattatgttaaaaaattaaaaaataatgaagctgctcgaattcgtcattgtatgatgtgtaataaaggctgtaccgatgcaatccaaaatagacaatttttaagttgtgttttaaatgctgaaaatggttatgaatacaaacgaataattaccccagcagcaacaaagaaaaaagttgtagttgttggagggggaccagcaggtttagaagctgctcgggtagcaaaaacaaaaggacatgatgttattttatttgaacaagacactagattaggtggtcaacttaatattgcagcgattccaccacgtaaagctgaaatgaatcgggctatcaattacttatcaaatgaaatgaaaatattgaatgttgatttaagattaggtaaaaaagcaactagtacagatatattaaacgaacatcctgatagtgttatcatcgctgttggtgccaataatgcttccctaccaattcctggcagtgatttaactcatgtgttagatgcttggaaagttcttaactatgaacaattccctagtggccatgtagcgattattggcggtggtctagtcggagcggaaactgcagaatttttagcacaaatgggcttggacgttactgtcatagaaatgcttgaagaaattgcaaaagaagaatcatcaactgtaaagccagtaatgtttgaagattttgaaaaacatcaagttaaattattgactaaaacaaaggtaattgaaattaaaaacgattgtatcaaagctgctaatggcgatggtgaattaacgattccatgtgattatgttattttagctactggagctaaacctaatccatttgatgtcagtgaattaacagctcacaatattgatattcatcttgttggtgactgcaatgaaaaagctgctgatattaataatgccattactcaaggttatttagcagccaacagtatttaaaactcttattatctagactaaaaagaattaatcataacatttaaatgtttaagattaattcttttttattcttattaactatctactattactagccattctaaaccacgtataattttttcctttgattgatactgataattgataaatattttctggccaagtacatccgccaaagcctccatccccgatagcatgaatatcacatccggtttgtttcattaaaagggcaacctgccgaattgtatcctcatcggcacattcgaccgaactatttaaaaaactcatggctaaagtacctggtttatagcgatgaatatattctactaattctctaatcatatctactgtgattcctgctctagtccctggagctggtaaatcgatacagtcagcaccagcatcaataagtcttttaataacatctttggtatcatatgctgctaaaggatcacctagtaccttttcttcgataccatcttcccacttgccagcaaacaagaaaatatcatctccacatatttcttttactaatttggttgcttcaattacatcttcaatcgatgttccagaacctggattaccacccaatacaataaaatccactcctaaagcaactgcttttaaaatatgttcttttgttgctaacattccagccaatcggtaaagtgttttttcatcagaacgcttttctcccttcttaggacaccctaaataaacaccaattggacaattgcatttttctttaagctctttgatagttaagccgcacaatcctggattattttcaaaattatctaaatctatagtattaagcataaccatatctgcaccaaacgaacaaagcaattcagcatttgtcacacccattaccgtccctgggccagcaaaaattaaatgttgtcccatgataactcgaccttccgatttatagatagattcttttaattctaaaggacccattttgtttatctcactctttgaagcattaatcaatctttttacgttgctcataatttttcctcatttctagattttgttttcttcaagtgttttttcttgattactttttttctctgcttctaaagcctgattgtcacaaatcttaaaaaatgggtaataaattatacatgataacaagcacataattacaatcatgattcctaaactaattcccccacctaaaataaatcccgcaattggacctggaattgtcattacacttaacattaaggcgggaatattcacaacacctgtaaccatcaacaaataaccaataatcataaatacaagtggtgttaaaataaacggaataaacataattggatttaatacgattggaaaaccaaaaataacaggctctacgatattaaacatccccggaacaaaacacacttttccaaacgctttaaaacgttcgcttttagcaaatattgccatatcgcaagtaagcccaaataaacatcctggtccaccaataaactgacaaaaaacaaagaaaaacatataagttgtgactaaggttacaggttctccggccatataattatttaaatttgtaattgctggttccatccaaattaccatcatgacagaaagtacaactgaagtaccatgaattccaacccaccataacagcaataatattaacatactaatcaacatggctggaaaactattacctaaacttactaaaggcgcttgaaccatagtataaataaaattttgaatatttccataagatgttacagcaaatccagaccttaccaataaaaacaaggctgatactaaaaatgctggaacaacagcttcaaatggtttagaaaccatttccggtaccgaatctggtaattttattttccaattatgattaacggcaaaagcaaaaacatatgccccaataatcccacataacatggcagtgaagataccactagcacctaagttatcaactgggataacattttttatcaatgttacagctccatttgtactatcaacattgttataagaaaatggtgtaaccaacaatagtgataataacgaaacaattgctgtttgaaatggattaacattaaacttttcacctaaattataacctaaagcaaaaatgaaatataatgctgttaaattacaaacagcaacccctacagctaaagcatcagatattccagtagacgataaaaaatttgtataccagtctcccaatggtaaaccctgaaataatgaaaatacagctcctcctaataacgctggcatcactttcataaatgcgccacttattgcacttaaaataaaattgttttcaattttctgtgcaaaaggtataactttattttggataaaatcattcataatttttcctcctcctaactttataactacattttatctagaagtataatcatttaagagtacataaaacttttcattagtccaaaataaaaaccaataaaaaaaataagtgctaaggtttcattttttgaaactttaatacttatccttggttatttaatcttgctaataagctttcaataatcttcattaattcaaatttcttcttaatccctggctgttcgtgtatctctaaaaaacgtttatgagtatacgagctctttaaagatatgatataattattttcgtcatttaaatgtctataaatattcctgatcaaagcattggatatattataatcatagtatttttctaaacttatctgaagatgactataaaaatataacgtatgttcatccatattaatagctaaattgttatcttcttcattaattatataaatatcataacctaatacataaaaatatttcaaatacattttccaaatcaacattgcttctcgctcaccaaataaaataatttgatgacaatgattacatgcaataactaaatcatcaagtttatcacgatcatcgagcaaataaataaaatcacaaatcacagcattaaattctcttacaaaagtctttttaaaatccgtgaaatgactagtttttatacttttacaaaatctaatgattgatgatttagatagaccggtatcataaataacatcctctaaagatagttctattagcttttccctttggtttaaaaaatatttaacaagaatttgatccgtattattaatttttgcattcattgataaatctaaaaggatatcgatcattttatcactgctcctgataaataatctcgtgataataaaatttaatcaaatcaaaataatacaacaacaaatactcagtctcaaacatttcattattagataatatattaattacctcaaaaacattgtaatgaaaatttatttttgtttcgcctgaaaaaataataactttattagctttatttcctaaaatcgacactaaattatcatcagataaaaaaagtctaccagtacctgaaatcaatataattaaatcattatcctctatttcaatagaattatcttttaataaagacgacattatcactgtcttccccattgaaatcatatcaatttgaaaattaaaaagaattggagttatcgtaggggaagcaacaataataactctctgactttgagctatttctttaatgatcaactttaatttcattttatcattgaattctaatggataatcaactaaatgtgaaaccgctacagctaatcgttttttgttaaaaatcttataacctcgatatatttgatctttacgaacatccaattcactttctaatctttctttaaaattcgaataattagaataaccaaatttttttaaaaactgttttactgttggaactgaaacaaaacagccatcagccacatcttgtaaagtaatacttcctatgtgattaatattttctataatatatttggcaatataataatttaaatctttattattagagttattaacaattgataaaaaataagctaagcacataaacatattatcttcctccactcattattaccattatataatattaattaaatttattcatttaaaaattagctttcttgtaccagcaaaaagctccaatcaaatttgcatcattataataatgacacactttgatctctggtggagttaccggaaatgggatgcaatcaaataaatcactcacttctttctttaacattgttaataataacggctgagtactaatccctccaccaatactaatattctctaaatctaataacatttgcatattaaaaatatatcttgcaagatttttagtataatcccgtagtatttctaaactagcaatatcattatgattagccttgttaaaaaaggctaatccatcgatcgaatttcgctctaatgcaaatcgtttttcataatttcttgttaaataacctacaccgccaatcaatccaaatgtattttgccaatcaaagtcatgtttagaatcaattaaagaaaacgtagctgctccagcaaaataattacacccacgatataattccccgttaataataattgcgcatccaactccagtacccaatactagtactgccccattactcgtttcttttaatgagcctctatacaattctgctaatgccgcacaattaccatcattttcaatcgaaactggtacgtggcatttactccaaaggatttgtttaatatttttattatcattaaatctataactaccaccattttttattaaacctgtaaagggattcatttccccacaataactaatcgcaattccggataatttcatgtgtatagttttaaataaatccactacccaggtaatcatttcatcatgactttgaaatattttattttctttatttacatcatataactgaaagttttcatcaataattgcatatttaactccggtgccaccaaaatctaaacataaatatttcattatttaatccctcatttcttaacactttaaagttatcatagttaaaaaaaatataaatactatataatttttggttgtgtcaaaaaatgaaacatagaaatctaatatgaactgttagctatgattattgtattgcagcaaataaatctttatctttgttaatatcttcttgaatgacttttttgatatataaagctaacatatatggcattttttcttcaaatgtatctaactggcaatttaataattccttgactttagtcattctataattaatcgtatttcggtgcatatataaatttttggccatcgctacttgactgccatcatgaatcaggtaatagaacaatgtcttttctaattcactatgatgtttttgatcataatctattaaaggctttaataaatgctgatacattcctgataaaatttgtttatcctcgattgaaaataagatttgataaactcccatctcttcaaaaagaatcatcggatatttaaattgttctgccattgcaactgcagctcgagctcgtttataacttaagattacttgtctaaaatctgtcattggcgttccaatacctaagtgaataaatcttgaaggcattcgcttctttgttcttttatacattttatcagtaattttctctaatgaatccggatctaaattatttacaattaatacaaaatatccatcaaaccaaaaaaatgtatatgggctttgtattttttcaaaacataattccaattgaaaagaaactctacgtcgttcaattgcatcaaactgatcagaatcttcaattccaattaaaacaacttgaaaaaaaccatccacatcaaatgcacctaacaattgctgccgaacctcctcaacaacttgaggagttgtaaaaacattctgaaataattttgaaatctgattgtcttctcgttgtgaatataaacagcgcatactaaaatccttaattaaatctgccatgtgtacttcccagggtgtcgttaacagcggaaaatcctgctcattacaatagtcaattatatcttgaggaatttcaaatatatatttacctgtattgataactaatccaacactatggtatttaaccaaacacttgataaaatcaaataacgaatcgtgactttgaaatcctaaacctgttgtaactgccaattcttttccccataattgttgaataattgtcgtatcctcaatcatgtgaacccaactcatcgcatttgaacagccctcacgaccagctaacaattttaaatgatattgctcttgagtttgtactaacgcatcttcaatcgtaaatcccattttactcacttcctttatatttattttaccattatttgtgcatgatgcacaaataaatcttatttttttattatttctgtctctataattattaaaatattaatatataatataattgtattaaaaacagaacatctaggagggacataacatgaacatttcttatggatattacgtactaactgacaactttgatacttgcccaacttgggttcgtgatgaaggatatttcaattgtgaaaacttttcaaaattctttaagttttttaaaaagaaataaataataatgagcattcataacgaatgctctttttcttttaagatttaaattatgctattagataattattttatatttaaagcagcttcataaccttctttaactgctggtaaagcattacctgccttaattgcgccacctactacttgaacatcttcacataattcatttgcaattttttctaacggattataggctttatatccaaatgctaagacaactaagtcagcagaaataacttctttttctccctgttcattaataaatgccactccatcatctaaaatttctgtcacagtacaattagctctggcagttactcctgattcattcataattggtaatagacagctcatattaatgggatccatatcagtcaaaacagctggtttcatttctagaactgttacatgacgatgcgtttgagcaataaatgtggcagtttcacaaccaacttcgccccctccgcaaacaacgatatgctcaacttttgtagcgatttttcctaataacacatcttcagcattgactacattttctttatcgatacctttgactgccggcaccagcggtcttgctccagtagccaaaataatagcatccgggttttcttgttcaatcatctcttttgttactaaagtatttaaatgtacttttacatgcagatcctctaaattctttttaaatacagatattaatgttgttaattctcctttaccaattggataagctgcagatctaaattgaccgccaacttcttcctgagcctcataaacagttacattgtgacctatcattgccgcagtttcagccgcctgcagaccagcaggtccccctccaacaatcattactttttttgctttttctacaatgtccattgaattttcatattcacgtcctacccgtggattaactaagcaagtgacttcttgattaaaaaataatggcatttcacatccttgtagacacccgatacacattttaatattcccatatttttctgcctttgctttattaggtaaatctggatcagtcaatgaaccacgccccattccaataaaatcagctttatccatgttaattaatgtatctgccatttgcggatcgttaattcgattagttacaattactggtaaatcaaccaatttctttacttgtgctgatatctccatattcaatgcatgttccgtaaacattggagcaattactgctctatttccaggtgaagcataagagccattagaaatatgaataccatcaaaacctaattcttcaaaaatcgtacataattcataagtttctgcttcagttcttccaccatgaacatattcattaccagaaagacggacgataattggaaaatcatcaccaacttgttttctcatttctaaataaatttcagcaactattcgtactctattttgtagacaaccaccatagttatcaactcgcttattgacaaatggtgataaaaattccgctaataaataaccatgggcacagtgtagctcaattccatcaaaaccagcttctttaacgcgtttagcagcactaccaaaatcttttactaattgattgatttcagcaactgtgatatctcttggttgttcttgacataagggacattcaattgctgaaggagcaactggcatatgatcttcattagcaattctagtagtttgtctacctggatgatacatttgacaaaagatttttgattcatacttatgaaccatcgttgttaattgtttatttccttcaatcaattcatctttatataaaccgggaattctttgatatcctttaccatattgttgaactgcataatcctcagtaataatcaaaccccagccgcctttagccttttcttcaatatatttcatataacgctcagtaattttaccttcaatcgtacaataatttgtcaccattgccggaactactaaacgattaggaatttttacagttcctatttgataaggggtaaataatttttttaaagccattttaatatcctccaatccttttataactttattttacagtatcaaatgatttgaaggtcaactctaatttattatatgtgatattattcacatattcttttttaatcacatatattttactaaaacaacataaaaaactctcaagctatttgagagttttttataatcggaatttgtatttctaaataccgtttaaaatgatcaccttcatatccacgccccctaataatcccccgtattggtaactgtacatgataacctttatcttgagcatacattactgctgcttcataacactcatgactaaactgtcctaacggtcccatttctattaccgtgcataaacaataatgagccggaataattgtatacttctttttataagaaatacttaatccattaaaatattcctcatcaatagcaaaataccattcatctttatctttattaaaacaaacataactatcaataaaattaatatatttatcatttaataaaaatcgaatattatcttcactagtattaactttatcataatcatcaccaattccatctacaaaatcaaaagcatattttttattaattttctttacccaataatttgataaatttaaatcagctacctccagttgcattgccaactctgtgactcgttttttcaacatgactttataatcaatctctttatttagtcgcctttggaaaatatgtaactgattttgaagcttttctctataattaaaattaataaaattaggaatttcttttattttcattcctaaattctgatactgtaaacattctaataaaatatatatgtcaaaaatactataatagcgatacccattcttttcatctcttataggatcaataattcccattttttcataatacctaatcatttcacttgataaattaaacaatcgtgaaatatcccctattttatactggctattcataatatcagctcctttacaaataattttatcacttaatcttcctatttaaaaaataattttattattagtttttataaatcaactattggtagatttataaattaattaaaactcgttataatcaaaatataaaggagaaatcaatagatggattgtattaaaattggaaaatttattgcgacatgctgtaaagaaaaaacttaacccagattgaaaaactaaatgtaacaaataaagctatatcaaaatggtcgaaattttatcgatgcttcattttatcacgattttcgcgatatcttaggcattactattaacgaattattagctggtgaacatctcaatactcaagataatcaatattactatgaaatgaatcttcacaatcgtattaacagttacaataacataaatcgaaaaaataaaataattattttcatgatttttagtacattgattttttagtcattacgtatttacaaataaaaactatatggatttttatcatggattcaatacatctaaaaatcattatttagaaaagcaaattcttgatctatttcattctttatcagtccctggcaacacacatccaaactttgatgaactttattatcggaaaatatttgaacagtctgatagtagtaaaatgtactatatttataccataaatactaagcaatattattttattgaaaatatattctaaacaaaataaaaggtatcacgaattatatgggagagggtccgtgataccttatatgactattatagcatatttaaaaaaataagcatttaatctgattaaactttaattagtttctccaaaagaaatctagatttcaagtattttagtctaaatatattatacttttaatctctattacaaagatttagaaatctttatcaaatcaactaaaacaaatctattctacatttcagttagagcattgttttttataataaatcatttttacaagtcatatacctaactaaccactataccaataattactttaataatatttcaagaaattgatacttaaaatattaatattcaatttcttcaagtgcatttttcaattgattcaaagcttgtcttaaatatgctcttgggcaagcaatgttaattctttgaaacccttttccttcttttccaaacatcgttccactatctagccataatcgagcatgttcaatcaataaatcatttaattctttatctgaaatttgtaatcttctaaaatcaagccaaagcaaataagttccctccgggataatcaactttatcaatggtatgtgttctttcaaatattcatctacaaaccgtgtattttcaaataaatattgctttaaatcttcaagccagcttgaacacgattcataagctgtctggcaagctgctaatccaaacaaattacactggctataaccagtactggcaatagcttttttaaattgtaatctcaattttcatcggcaataaaaatatttgaaatttgtaatccggccaaattaaaagttttagtaggagccgtacaggttattgtaatattctgtaattctgtctttaatgatgcaaaaacatgatgctgatgccccggataaataaaatcactatggatttcatcactaataattttaacatcatttttaaggcagatttgccctaattttaatagctcatcttttttccaaactcgaccaactggattatgtggcgaacataaaataaacaattttactttttctttcttaatcttctcttcaaaatcatcaaagtctatttcataatgagcgttttttaaaactaaagaatttgttataacacgtcttccgttatcaataattacttctttaaaaggataatatactggtgtttgaataattactccatcacccaatttagtaaatgcccgcactgcttgtgctaaagcaaatacaacaccaggcgtcttaactatccattccttttttatttcgtaattaaattttgaccgataccaactataaatagcttgataataaccatccttactatcactatatccataaataccatgatttaccacatcatataatcgttgttgtatttctggagcaacgataaaatccatatctgccacccataacggtaaaatatcatcaggacgttctctttcactagtgaaatcatactttaaggagtttgtatcagtacggtttattattgaatcaaaattagattttatcattatcaccaaaagcctgcctcaaatcagctaataaatcatcaatattttctattcctactgataatcgcaaaaaattatctgtaattcctaatttagctctaatttctgctggaacatcaccatgggtttgaatcattggataagtaatcaatgactccacacctccaagactttctgcataagtaattaattgtacattttctaaaatcttttttgctaaaaaatgattttcaacactaaaggctatcatgctgccaaagccgcgggcttgatttctattgatttcatatcctggatgctctattaaaccaggataataaactttgctaacccgcggatgccgatttaaccagtttgaaattttcagcgcattttcttgttgtgatttttgtctgattgccagcgtcttgatcccccgaatcaataaataacaatctagtggtgacaagctatttccaactgtctttgaaacttctctaatccttttagctagtttatgatcaccagtcgaaatacttccagcaataatatcattatgcccacttagaaacttagtagcactatgaattacaatatcagcacctaataataatggattttgaaaatatggtgaaaggaaggtattatcaacaattagtaacagcttgtgggcttgacacaaggcactaattttttttaaatcacttatttgcattgttgggttactcggcgtttcaataaaaacagcttttgtttgaggacgaatatactgcttaaaactctttaaattagttgtatcaacataactgaattttaaacctttattttgctgcaaagtaaatagtcgagttgaaccgccatataaatcatttgaacatatcaaatgatcaccactactaaaaagttctagtaccaatgaaattgctgccattccactagaacaagcaactgtatcaactgcgccctctaaattggaaataatctcttctaaataagctcttgttggattactttcacgagaatagttataccctctgctttccccaatcccaggatgagaaaaaattgctgtttggtatattggaattgaaacagcaccataaggatgctgtttcaattctaaatttgcaggatgaatacaacgagtttcaaattcatatttcatacttttctccatttccccacgctaagcgcatggacacaaatatttcttgaaagacattctgattccttctactcgttagaatatcttgtataattataagtcgccgtcatcttttcgagcacaaataattaggactcagagcctggacacttattattgatatattaccaatttggtcatattgctagatgacagtcagtaccacttctcctttctttgaaaggaggttttattttatgaagattgttcgtaaaatatgttgtggcatggatattcataaaaatcttattgtagcggccatcgctgcttctggtgataataatgtcacgacctatattcaaaagcagttttctacttttaactctgatttgttgaatcttttaaactggcttaaatcaaacaactgttttgatgtttgcatggaatctaccagtaagtactgaattcctgtctttaatatccttgaatctgaactcaatatttttcttactcatcctaaatacgtgaaggtgattagaagtaagaaaaccgataagaaagattcaaaatggattgctaacatctttaaacaagatcttctcaagtactcttttattccacctaaaaacattagagaacttagaaaaatatcacattatcgcattaaacttgtcaataagcgctcttctgaacgcaatcgttatcaaaactgtatgactgtttctaatattgccttagcttctgtctctactgatcatttaggaaagaattgtaaagctgccatggatgagattctcaaaagtgatattatcactgaagacaatcttaagaaaattctcaagggttctgtttcaaagaaatctgatcaaatttttcaagccattcagaattctcacattgaatctgaccaaagattcaaaatcaactgcactataaaacacatgaataatattgacgaatatattcaaaactggttagtatttgaaaccatttcttgttcaatgtgctctttcggctatcaagagtgaaaaagaaacatatttcagaatcaagtataatcgtattaagaaacgacgtgatcataagaaagctattatagcgaccgctagaatgattcttatttctatataccatatgacaaaaactggtgaaaacttcaatccatctgattatgaatcattaaaaaatccaaaaccacgcaaccagaagataaccactcatcaagcattagaattattgaaatctatggatattgatataagccaaatcaatttatcttctattcaacaaacgagttcatcatgaatttttaattttttaggtcggctttttttataaatttctttcacacttatccccttttaattatagctaggtacataccataaaccattattatttttatctaaatattctttaaattcttttgaacgataagcttcaacaattgctttagcccattttgtatctttatttttttcttttacaactacttgtaacaataaatgttctaaaacatcctcctgtaataacgcactcgaagcatcaattcctgcattataaactatgctgccggtgattacagcataatcaaactcatctaaagcttgaggaatcattgttgaatccatttctgtaaactctatttcataaggatttttaataatatcatcttttgtcacggaactaatatccacatctggatctaaagtaatatactttgctttttgtaataaaacatatgctctagatgtatttgaagcatcgtttggtacagcaatcttagcgccctttttaatttcctctaagcttttatgagtatttgagaaaattcctgcaggtacagttggaattgctgtcaaagctactaaatcaccatcttgtgattcattaaaatttttcatgtaagctgtatgctgctcaacattgacatctatctcgccttcatttaaggctgtatcattttgcaataaatctgaaaattcgatgcatttaaattgataaccttcttttttcaaaattggaataatggcatcttcaaataagactgtatatggccccgctgccttaccatagataattgttgtcttatcttcacttttatcactactactttggcatccggccaaaacaaaaaccatcactaataataaactcaatattctctttttcatttttcttcccctattcatgtgttctaatttttttagataaatgatttcccaatgtttgaattaattgtacaaagataattaaaatgattacggtaacaaacattagagtattattaaaacgctgataaccataagttaatgctaaatcaccaacaccaccgccgccgattgttccagccatagcagttgcccccaataaaccgatcgttccagtagtaagtgctaaaactaacgaagctttcgcctctggtaataaaaaataacgaatgatttccaaagtatttgcccccattgctttagcagcttctaaaattcccggttgaacttctaatatagaactttctatcaaacgagccaaatatggtgcaatataaaatactaatggaacaattgcagcctttgttcctattcttgttccaaccagcacttttgttagcggagcaataaatactaataagattacaaatggcacagatctaacaatatttactaacccactcacaagaaaatgaattgtatgattggctttaactccattttttctagtaaggactaaaagtaagcctagcggtattcctatcaaggttccaaaaaataatgatattcccaacatataaattgtctggcctgccgcttcaagtaatttatcagcaggtatatttaaataattttcaatcataattcaattccaccctctctatcttcacatcttgtttttgaatataatttatcgctcgaataacttcatcctgttcaccttttaactgaattgttaaaattcctaaaatatcttctcctacttcattaactgaagcaaataaaattgttgttataattttaaaatgcttattaattttagaaattacatcatgctttgtactttcaccaaaaaaagtaagttttaaaaccggataccgataatctaattcttttaaaagtgtggttggaattacattgctaataactgtttcaacaaatctctttgtcatttcttgttgtggattactaaaaacctctaaagtatcacctttctcaatgattttaccagatttcattaccgctactttattacaaattttcttgattacattcatctcatgagttattaacaaaattgttatcccaagttcacaattaatttttttaagcagcaataaaattgcttctgttgtctgtggatctaaagcactagttgcctcatcacagagtaaaatcttaggttctgtagctaatgctctagcaataccaattctttgtttttgacccccagacagttgtgatacataagtatcacgcttatcttccaattccacaaaagataataattgtttaactcttacttcaatagcttttttatccagttttgaaagaatcaatgggatagcaatgttttgatagactgtttgtgattctaataaattaaactgttgaaaaatcatacctatatcttttcgtaaaatatttaattctcgttcttttaaatctataatattttgattattaatatagattgccccattttcaggacgttccaataaatttaccattcgtaataacgttgatttaccagccccagaataaccgattacaccgtaaatatcacccgcttctacttctagagagacatcttgcaatgctggaacttcaccacttttagttgtaaaagtcttatttacgtgttcaattttaatcattctcatctgcctccaattttaaaagagcctgtttcgccaattggctaagatattttgcagctaacgataaagctgcaggatttaccttaaacttcggatgatgattaggataggtctttccggttccgattttaataaatgttcccctgattttttcaagataaaatgcaaaatcttcgcctcctaaagttgcttcgggtatccctatagcaattttttctgcttgagcaattgctttagcaaaattactccattcctcatcattgacggttgcaggaggccccgctatccactcaatttctgtatcaagatcataggcttggctaatcccataagttatttcctttaatcgttttccaaacagctccctctcctcgctagtcagcgttctaacagtcccttcaattaaggcttgttcaggaataacattccacgtattccctgcttgaagatgtgtaatacttaaaacactactattaaaaggatccatatttcgactaacgatcgtttgtaagctgttaactaatgcagcagctgcaacgattggatctttagccatttgtggatgggctgcatggcttccaaagcccttcaaattaattttaaatcgatcaacagcagctgaaactgtccccgctttaattccaattgttcccacttcaaactgcgaagtactatgaattccaaaaattgcattaacatcatctaaaacccctgtctcaataatttttagagctcctaatgaagactcttcagccggttgaaataataattttactgttccatgtaattgagcagcattttcatttaacaataaagcaacaccataaatcgttgttaaatgaaaatcatgaccacaagcatgcatctttccttcaatctctgacttatagcttaatgtcgtttcctcattaactggtaaagcatcaatatcacttcgtaaagcaattactttaccagggtatccacctctaataactgcaactaatccagtttttaatggtaaatctaaaacttcaatatcatgctcttgtaataatgttttaattcttttagtagtttcatattcctcataagataattccggattacgatgaaaccactcaaattgatattctaattctttttgtaaactgtcgtcttccattctaattccccctttttaataacaaaagtgggatgtttatgtaaacatcccactaccccatttaatatagtattaagaatatttgcatacacgaaaatgtaccctatacttttgtatacagctgcacatacacatatacatcatatctcttctgctttttaacatcatcgttcgctcctcttcttttcctactatatcgataggtttgctatgtaaagtatcttaacacactataaatactccgtcaagcaaaaaataaatgtcaatatgtttgcataaaaaaaatagctaattagctattcttcgttgatataaataaactcctaaagcagcaccaataataatgatatatccaactatgctccatatatcaggaatttgatttaagaaaataaatcctaatatcgctgcaaataatatttgactataatcatagattgaaatatccttgccagctgcattattatacgccgcagtaattgcaaattgaccaccagctgccattaaccctgcacctagtaagattaaaaactgttctaaactcatcggctgataattaattattaaatatggtaacacactgagacaagaaaagcatgaaaagaaaaatacaatttttgcaccatttaccccctgcttacctagcttccgcacacaagtataagctattcctgctcctaatgcccccaaaacaccaataattgaatccacattatttaaaagattaaaagatggtttgattacaaacaagcttccaatgaaagctacgataattgatattttttgtattcttgtcgctttttcttttaaaaacaaagaggaacaaataattacaaaaaatggtgataatttattaagcatcgaagcatcactaactaaaagatgatcaactgcataaaaattacaaagaattcccaacgttccaaagactgagcgtaataaaagcatcggtaaatttttttgtttatatgtaaatccctgtttactttttaataggataaaaaaagcaaataaagcagctaccaaatttctaaaaaaacttttttgaattgatggtaaatcgccagctaattttacaaatacattcattgctgcaaaaaagaaagcggctaaaattatacacatcatccctttacggatattattcataagcacctccagatactataatgattatatctattataaccattacgtcaattaatatgatttacaacaaaaaaggataactttcgttatccaattaattattattgaacagcaaatataagttcagctttacaaactaccttaccatttaccttagcaacagcatcaccaattccaattggtcctttttgtttagttagagtacattccatttctaaaacatcaccaggcgttacttgacctttaaacttacacttattaatgcccccaaagaaagcaattttacctttattttcttctttagaaagaattgcaatacacccaacttgagctaatgcctcaacaatcaatactcctggcataacatgatgctcaggaaaatgaccacaaaaatgcatttcattaacactgacacatttaattccttttgcccactgtccaggctggtaatcagtaattcgatctactaaagcaaaaggataacggtgcggattgatttcttgaatttgattactatttagttccattttcttattctccatatttcttaaagatgatagtcgcattatgaccaccaaatcctaatgaatttgacatagctacattaacatcttgatttctaccagtatttggaacgatatctaaatcacataatggatctggtttttgataattaatcgtagctggaataaatccctcttcgattgctttaacacaaattaccccctcgattcccccggcagcacctaaacaatgccccgtatttcctttcgtcgaagaaatagcaacctttttagcagcttcacctaaagcagatttaattgccattgtttcacctttatcatttaaaggggtactagttccatgtgcattaatataagttacgtcttcagctactaaaccagcatccttgattgcattgatcatcgctttagccccaccagagccatcttctaaaggtgcagtaatatgatgagcatcacaactgacaccatatccgaccatttcacaatagatatgagcgccacgagctttagcatgttctaattcttcaagtacaacaattccagcaccctcacccataacaaatccacaacgttcctcgtcaaaaggaattgacgcccgtttcggatcattattatcacaaagagctttcattgatgaaaagcctccaataccaagtggagtaatactagcttctgccccaccagcaaccataatttcttgataaccatcacggatatttctaaacgcatcaccaatcgcattagttccaccagcgcaagctgtgaccggacaagtacataatccttttgcccctaattcaattgcaatatttcccgctgccaaatttgtaattgacattggcacaaagaatggcgaaacacgatcataacctttttctaaccccttagtatgatctttctcaattgttgcaagccctccaattccgcttgacacaactacaccaaaacggtcagcatcaatctcttcaatctttaaaccagcatccttaaaagcctctttagcagcaattacaccaaattgagtaaagcgatccatttttcgaactgcttttttatctaaataatcagcagcattaaaattttttacttcacctgcaatttttacttttgttaattctttatcatagtttgtgatttcgtcaattccacaaacaccttctttaatacttttccaagtttcttcaacatcatgaccaattgcattaattgctccaagccctgttactacaactcttcttctttccattgtctctctccttacattgccattccgccatcaacatggatagtttgaccagtaatgtatctagcatcatcacttgctaaaaatactaccgtattagcgatatcacttacttgtccaaaagttcctaaaggaatttgtttagccatactttctttaatatcttcaggtaaaacatcagtcattgcagtttgaataaaacctggtgctaccgcattcacagtaattccccgactaccaacttcgcgcgctaatgacattgtcattccaataattccagctttacttgctgaataatttacttgaccagcatttcccattaccccaactactgatgacattgaaataatacgaccataacgttgtttcatcataattttagtcgcatgtttcatacaattccatgttccttttaaattaacatcaataactgcatcaaaatcattctctttcattcgcatcaacaatccatctttagtaattccagcattatttacaagaacatcgattcgaccaaattctttaatgatttctttaaacattgtttctgtttcttcaaatgaagcaacattagcttgagctaacataacagtcgcaccgattgcttctaattctgatttagttgcttcagcaatttttttattatcaccaaaattaacataatttacaatgatcttagcaccttcacgagcacaagttaaacaaatttctttaccaattccttgggctccaccagttactaaaactactttatcttttaatttcatcttattctccttttaatcccgctaatgttttttctaatgatgcttgatcttcaacttgataagttttaattgtcttatcaatcttacgaataaatccacttaaaactttaccaggaccgatttcaataattgtatcaaccccgttttctaacatataacgaatactatcttcaaaatatactgaagacattacttgcttctctaacatttgagcaatactaactccagactcaagttctttagccgaactattgaatattacaggaacttgcatttcattaaaattaacacttacaaacttttctttaagttcattactagctgatgctaataattctgtatggaaaggtccacttgtatttaaaggaattgcccgacgagcacctttttctaatgctaattcgctagccttagtaactgcctcagcctcaccaccaattactaattgtcctggacaattatagttagcaattgaaacaactcccaaagccctagcttctttaactgcttcatttaataattcgcgatctaagccaataattgcaatcattttgctttcaattcctgctgccgctctttccatcgcttgaccacggaaacgtactaaattaattgcagtttgatcatctaaaacacctgctgcatttaaagctgaatattcaccaagacttaatcctgctacataatctggagcaattccattttcttttaatagcttagttgctactacagcaacagcaaccatacatggttgtgtatttcttgttaaagaaagttcttcaaggggaccttcaaagcataatttctttacatcaatatctaagtcaatgttatcaaaaacatctttagcaatttgatagttatcatagaatgattgacccattccaactacctgactaccttgaccagcatatacaaatccaatcttacccattattttagtcctctctttaattcatccattaattcttttactgaaataattttatcattacgatatccattgcttccactaaatactaatccctcatccaaattacctttagcagcattgatcaatgcaccactaatacaataaggcgtagttttaacatcacaaggaattaagcaattataacagcgttttactggaatcctttcatcttgtttaagtctttttgtcaacttcgtcatgatggctcttcccggcattccaactggtgatttaacaatctcgatatctccttttttagcatttataaatgcttgtttatatttaatatctgcatcacattcctcagtacaaataaaccgtgttgccatttgaacaccatcagcacctaaatctaaatacttttgaatatcctcactatcataaacaccaccagctacaaaaataggaatatccttttgatatttttcaacaaatggttgaacagtctcttttacttctttaaaaatatctactaatttagccgttgttttatttaacacatcttctttatgaaagcctagatgaccaccagcttcacttccttcaatgacaacaaagtctggagctaccttaaatttacgatcccaagttttacaaatcaatttagcggctttaccacttgatacaattggggcaattttaacttttgttccttgaacaaaacttggtaagttcataggtaatccagcacccgaaataattgcatctattttactttttacagctacttcaactaaagctgcatagtcagtaattgcgaccattgcattaattgcaaccatccctttacctttagcaatctctttagctttctttatttcattagctagctcacgtttattagcttctagcggatttttttcaaaatcatcagcacgataaccaggatgagcagttgaaataacacccataccaccatttaaagcaacatttccagccaaatttccaagtgaaataccaactcccatgccaccttgtatgattggtacatcaagagtcatatctccgatatttacctttttcataattaaaactcgctttctaatttcttaaatgccttatcacaatcatcaaataattctttaataattacttttagaggtctaatttcattgatcattccgactacttggccagccattaatgaaccggtatcggcgtcaccttctaaaactgctctacgtagtgaacctaatgtatatttttcaagttccatcatgtcagcaccttctttttcacgcttaacatactctttagccattttattttttattacccgtactggtgttcctgcgattcttccagttactgtagtgcttgtatctttagctttgattacagcttgtttataattttcatgaatcggacactcttcgcttgcaagcagacaagttcctacctgtactccacaagcccctagagcatacgctgccaatacctgttttccactcgcaattccaccagctgctataacaggaacactaactgcttcaactacttgaggtactaatgccattgtagttaattcacctatatgaccacctgcctcagttccttcaacaataattgcatcaacgttatatttttcaaggcgctttgctaaagctacacttggaacaactggcaatactttaattcctgctgctttccatgcagcaacatatttaccaggatttcctgctccagttgttacgaccggcactttttcatcaattactaattgtgccatctcatcagcacaaggattaatcaacatgatattgacaccaaaaggtttatcagttaaattacggcaaatttcaatattcttttttaatgtagcagtgtccattccaccggcaccaattaaaccaagtgcgccagcattagatacactagctgcaaattcaccggtagcgatatttgccattcctccttgaatcaaaggatattcaatatttaataatttatttaatttcatcttctaactccattccattaatgttgcgccccaagtaagaccaccaccaaaaccaacacaaataattttgtcacctggtcttaacattcctttttcattcatttcacctaaagccaaaggaatgctagctgctgatgtattcccatattcttgcaaattcatataaaacttatcttctgaagacttcatcttcttatatacatttttaataattcgataatttgcttgatgacagacaacgtaatcaatctcatcaagagttaaatttgttttttctaagattgcattaatactttcaggaattacttttattgcaaacttaaacacttcctgcccagccatcgttaaataatgatcctgattagatttactgattgccggggcctttaatgcttctaaatttcccgctgaattactgtagctagcaaaaataccatcaccatttccaactacaagggctccagccccatcaccaaacaaaacacaagtattgcgatctttgaaatccattattttggaaatttcttcacttccaatgactaaagcatatttctcttccatgttttgtaataatgcctgggctaccgttaaggcatacacaaagccgctacaagcagcatttaaatcaaagcacattacttcttgatcattcaaacctaatctttcttgaatcaaacaagcagtgctgggagtaaaataatcgggtgtcattgttgcacagataatcaatccaatcttacttttatctattttttcaactgcctttaaagctgcttgatacccaagttctacgcaactttcattttcagcaatatgtcttctttttatcccggttctagagacgatccactcatctgatgtttcaaccactttttcaaggtcgaaattatcaagtactttttgtggtgcataataaccagttgataatatttttaatccactcatataatctcctaatatttttctttgatatcttcaaagaaatacaataactgttgtaatgatttaatcaataactcatcatcaagaacatgactatcttcacagacacgacttaccatctcttcatgaaagtctcgatgtactttgcaaacacgattgcctttagctgtcagctctacacgaataatgcgtcgatcattatcatctttacgacgttttacgtatcccttagcttcgagcttttttattgctgtcgtaattgttccattagttaaagtcgcctgagaagcaattgttgacatcgtgggatttgaaagcgaactgattgcatcgataatatgcagttctgataaacttaaatcttccactccatgtcctaccatatattgggtttcaatatccaaaatttgattaaacagtcttacaaacagttgattaattaattctcgatttaaaatatcgcgattagtcattcgtaattcgacccatttctctaaatttattgtaacgtttatttactaatgatgtttttgataatttcatcaattcttcaagagtatttcgaagatagattcttaaacgtttgtatacatattcgcggttctttgtaattccacctcgaggttctttgatgatcttatcaatgatcttcatttcatataaatcatttgcagtcaatttcattagctctgcagcttcatgaactcttgaaccatctttatctttccataagattgatgcaaagccttctggtgataaaaccgaataaacactattttcaagcattaccatacgatctccaacacttagtgccaaagctccaccactgccgccttcaccgattacaatcacaataataggcaccgtcagctgtgacatttccattagattacgcgcaattgcttcaccgattccatgtttttcagcttttaaacccggataagcacctggtgtatctacaaatgtaacaattggtcgattaaatttttccgcctgtttcatcaaacgcatcgctttacgatacccttctggtgaagacattccaaaattacagtgtagattttcctctaaagttcgtccttttaaatgtccaattacagtacagggaatattattaaacattgctaatcccccgacaattgaaccatcatctttgtaaagacggtccccatgtaattcaataaaatcatcaaataaattatcaatatattcacggacattaggacggtcagctttacgagcaagataaactcgatcataagcactaatatcctgatatgcttcagcttcaatttttgcttttgtattttctaaatcttgaatttgtaaagtgtggtcaatctcttggtcatcctttaattttaataactctaattctatttctttaatttttatttctttttcttgcagtgacattattgcgcccccctgctatgcatttttaataatttgataatcgtttcacgcattttagaacgttctacgatcatatcaataaatccttgatcttgcataaactcggttctttgaaaaccttcgggtaatttttgtttaattgttgattcaattactcttggtcccgcaaatccgattaatgctttaggttccccaataataatgtccccaagcatggcaaaagaagcagtaactccaccagtagtaggatgagtaatatacgaaatatataacaatccggcttcatgatgtttggctagagcagcactagttttagccatttgcattagtgaaataattccctcttgcattctagctcccccagaagttgtaaaaataatgattggacatttgcgttttgtcgcatgttcaattgctctagtaatcttttctccgacagcacctgacatactccccattaaaaaacgagaatccatcacacaaacaacaacttttcttccatcaattcttcctgtagcacaaacaaccgcttcgtcaagatttgttgtttcttctaattttactaatttttctttataaccaggaaacattaatggatcatttgatttaatacttttatataattctttatattttcccccatcatacaaaagatttaatcgcgtgtatgcccgcatctttaaatgtgctccacatttaggacaaacataataactttctttcaaatcttcacttaaaatcgactctccgcaagaatcacactttgtatataaaccatcgggtacatcaattctttttttatcttgcattttattacgaatagatttaaataaattcaatttttcttttcgtgccttaaataactcttccatttattatcccaccaacttatctaagttattttcaataaaacttgtatcaaaatttccttttacatactctcccgtatgtaaaatcaaatattgtaattcttggttagtatcaattccgtcaataactaattcagctaaaactctacgcattcttctaattgcttctaagcgattagaaccatgaacaataactttagcaatcatggaatcataatgtgatgaaactttatacccctgatataaagttgtatcaattctcacccctaaacctcctggtaaatgaacactattaacagttcccggacacggtctgaatccctcacgtggattttcagcattgattcggcattcaatcgcatgtccatttaaatgaatatcactttgtttataagttaatttttgatttgcagcaattctaatctgttccctaattaaatctaccccggtcaccatttcagtaattggatgctcaacttgaattcgagtattcatttcaataaaataataatttccatcttgatctaaaacatattcaatcgttcctgcattgcgataacctgctcctttagccgctttaactgcatcttcccccattttttgtcggagcagtggcgttaaggctttacttggtgcctcttcaatcatcttctgattgcgtcgttgaatagaacaatcgcgttctcctaaatgaataacatttccataattatcggctaaaatttgaaattcaatatgtttaggatttaaaattaatttttctaaatacatatcatcatcaccaaaacatgctttagcttctgctttagcagttaaataagcatcatcaaattcttcttcgctaaaggcttttcgcattccacgaccaccaccacctgctgaggctttaattaaaactggataaccaatttgatttgcaacttctttagcttcttgtaaagtatttacacttccatcactcccaggaactaccggcacacctgcttcaatcattttttgacgggccatacttttatttcccatcatatcaataacatcgccactaggcccaataaaagttattccacattcttctactaaacgagcaaaagttgagttttctgataaaaagccaaatcctggatgaattgcatcacaacctagtgcagtcgctacacttaaaatatttttcatatttaaataactatccgctgccttggcaggacctatacataccgcatgatcagccaattgcacatgcaatgaagtactatcaacatttgaataaacagcaactgcttcaattcctaattcttggcatgttcgaattattcttaccgcgatttcgccacggttggcaattaaaattcgcttaaacatcttaactacccttcaatgatcattaacacttgatcaaattcaactaaatcttcagtatttgccatgattgatgttactgttccatcaattggagctttaatttcattcattaccttcattgcttcaacaatacacaacacctgtcctgcttttactttagtgcctacttctacatacggtttagcagttggtgaactagatgcataataaaccccaacaattggtgatttaaccggtgttccggtgattgctggttcattagctgctacttgctccactggcgctaaagtaggcgttggagcagaaactaccggtgtacttacaacatttaccggtgctactggcgttttttctaattctaatttaatatcatctatctctactttcattttaaaaacttctgagttttcaaattcatttataagttgctttactaaatctattttcataaatactctcctttattttgaatatcaaagtaattttttaaaaaaattattacccagctattctgggtaataaaaatcagcatttattatgcattttctttgatataatctacgatatcttgaactgttttaatttcagctgctttatcatcagggatttcaatatcaaattcttcttcaactgccatgattaattcaactgcatctaatgaatctgcatctaagtcttcttttaagttagcttctaaagttactgcatcttcatcacagcttaaagaatcaacaattatttcttttactttttcaaattccacgttatattcctcctcgtgtatattacggtcacattataacaaaatcaaaacatttgtaaatagtttgatgttcaaaacttttatcgaagactgtcgaattaacccaaaacctagtaaaatcaaggtgtttcaagtaatattttttttcgttttttttatgttttaatcgtcatttttttatgttatagtcttttttaggagggcacaattaatgaaaatacccgaaataaaagctaagacaatcattcaaaacaaagccgataaaaatcatttttggtttggttttgactacaacatgaatctctaccaaggatgtcatcacggttgtatttattgtgacagtcgtagtgattgttatcaaatctcaaactttgatcaaattaaagtaaaacataacgtactcaccctactttctaaagaactttgttctaaaaaaagaaaaggggtgattgcaattggagccatgtctgatccctataatcattatgaacaacaattaaagataactcatcaagctttaaaaataataaagcaaaccaattttggtgtaatgataacgactaaaagtcatacgctcattaacgatcttgaactcataaaacaaattaatgataaacaatctgtcctaatttgtatgaccattacttgtggtgatgattcattagcaaaattgatcgaaccaaatgtttcaatttcatcaaaacgatttgaaacaattaaacaattacgccaacacaatatttatgctggggttttaatgacaccgattttgccatttattaacgatacccctgaaaatattcgagaaatcatctatcgcgcacatttagccaatgccagctttgtttatcctatgtttggtgtgactttacgagatcatcaacgtgattatttctatacgcagctagatcatttatttcccggctgtaaggaacgctatataaaacaattcggtaatacttatttatgcaacagcccacgactttatgaattaaaaaatatatttattgaagaatgtcacaaatataatatcatttataagatggaagatattataaatggttataaacaaactgcatcatcggaacaattgagtttattttaaaaaatagtccagaagatcttctggactatttagcatgttcatatgtataattcattaccacttaatagataatactcatctttttttagtatcaatgttttgatagtctaaacgtttatacaaattatcaatatattggtgttttaaaacctcttgaaaactatatttaaaattcaaatcaaatacaaatactaaatgtggtaaccaaatatctaaatcattttgccgacagctgcttaaaatcatttcatgattcaaaaatgactggtacactgctctcactaatcaattgtttttctatttcttcttttcccttataataaattgtttctagcgggagagtagattaatttccagcttatcgattttgttagcatcacggataatctttgcatgcagtaattcatgagtatctaatcccattcaaatcacatatttattgtgctttttgattgctttataaataatttgctcattattataaatatcactaaatttttcaatcaacctatcttaaaataataaagagacatcgaaatcatattcactgacataagtattaaattctttatatgcatcctctatttttatcattaactttcctcaaaaaagtgatcttaattattaagatcactcttttcttttaaatattcattagcatggttcattatatttaacatcttcttaaaagtatcactattttgataattaagtcgtttaactaattttgtaatataatcttgttgataaacataattacaactatactgataattcaaatcaaatatcaaggccaaaaaggatacccagcgatccaagtcagttttacgagtggtactaagaattgattcactattcataaatgtttcatatatcgattcagtaatgatgtcattttctaaaatctcttgtccagcatccaaaaatgcttcgaacgtttctaacaaacctgttttaaagatatcgattttgtcagcatcacgaattattttacagtggagcatctcatgttcacttaatccctcagcaattttatatttattatgattaaaaatagctttgtagatcagtggataatctttttgatcaatatcaaatttactaattaaattatcatcaaataaaatttgaacacctaataatgcatgatcaattgttttactatcaataaaacaattataacgttttaattgttcaaatctcccaatatcatgtaataatccaattaatgatgctaagtctatttcatcttgatctaacccgagactcactgcaacattttttgaggcctccataacacgataagtatgttctatctttaaggcaactttaggattatttttatcataattcgctacatattcatcaaacaatcttttagcattttttaaatctatcatctaaccacctccagctatcattatatgctctttaacagcatttctctactattttctaaatagtaatttctatttttatatggttatgttatattaataaacaaggatgtgattagatgaaattaagattaactactactaatgatttaaccgctgtcatgacaattatcaatcaagctaaagtatattttaaagagcaaggaatcaaccaatggcaagatggttatcctgatgaattaactattattaatgatattagccgccatgaagcttatgtgcttgaagataacggagaaatagtcgcaactgcgatgatctctaaagagcttgaacctagttataattatatagaagggaaatggcttcaagataatgcatacattgtagttcatcgcatcgcgatacgaaatgatcaaaaaggtaaaggcctggcaaaaatcattattgatgaaggattaaaactttatcctaaaaaaccaagtatccgtatggatactcatgatgataatctttcgatgcagcgtttcttgattaaatatggatttgaatattgtggcactatttatttagaaaataaagaaactcgacgagcatatgaaaaaattctttaacctgcattacaaagtgcaggttttattgttcaataaaatcaatcaatacttgattaaaacgttctcgttcatcataaaaaatcccatgtccactatattcaaacttgcataaaatcgaatcttctatacattcatgcatgattaaagcaaacgaaaaaggacaaattttatcaagcactccatgcatgattaaagtagtgaccttaatctcaaacaaatcttgatacacatcttcatctcgtaaagaaattgctgtttggatcgttcctattcctgatccctttaaacaaattgatgtaaaccagttcataaattcactgccatgatttaatgcaaaaacattttgtccgaaatcatgaaccattttaggtcgattagtataacactgctcaatcagttgatttaccgcatcgatactttgtccttcgggattatgaattgtacgagtatatgaaggcactgcagcaccagccaaaactagtttacttactcgttcttttccaaatttactcatataacgaacacaaatcgccccacctattgaaaatcctactaatgtcacattatggacatttaaggttattaaaacactatgcagatctatcgctaattggtcataatcatagcccctacccatgacttgtgacattcctaatccacgaatatcataactaatgatgcggtatcgacaatcgtttaaaatatctttttgatattcatacatttcttggcaaattggccagccatgcactaaaactactgtcttttgatgagctggattaatatcctctaccgctaatttggcattatctgatgattttagataaaacacataatcccccctcatcatattctatgtaagctcaataatattataaccttattttaattattaatttttgtataccagcagtcgattaagttaatcaatatttactatgattcgctatcattaattttgataaattatattgtgatattggagtgagaatattaatatatatcatcagtgcaattattatctatgggtatagttgttattattttaccagtactatcgctaatcttttaattgcattaatagccttatgagtatttggtatatttaacatcggattaattttcttaaggaatgttcgcataaaaaataattatagtggtctcttgtaagttgaaacattccttattctcagcttgtttttaaatgattttaatagcttgagcgactataaccccattattctttttactaacagaaatattactatgacatataatatttctgttagtaacttgataattacaataattttgactattatcttagttattttcaatatttatatctttaagtgtaaaaattatttcatttgtattcatatcttattgtattcagcatatttttatatgaggtgaagaacatggatactaaagtaaataagccttaccccgaaataaaagtaactgtgccaaatgaaacttatggtttaatgatccttgataatgtcggtgggatgaattctgaaacatctgcaatttgtcaatatatttataaccatagtattgctggcgaagattttttagaactaaaaaaaacatttttaaatatttctatggtcgagatgcatcatttagacatcttcatgacccttgccttagaattaggtttagacccccgctggtggagctgtctaaatgatcaatgtacttattggtcaccatcatatttaaattatcctaattcactagaggaagtactaaaaacagcaatagacgctgaatatcaggcaattgataagtatatgtatcaagctagcgtcatcaaagatccctatattgttgcgattttaaatcgaatcattgaagatgaagaactgcatatcaaggttttaaaagaatgggaaactaaattagttagataatctaactaattagttttccttcttttaataattgcaataattgtaaattttgcgccgcactacctacataattagtaattccattaagttttgctaaatgttgtcgattttcaaaacttgtatcaacattaatttgctgaagggctccaactaaactatctccaacataattaggatttgacaaatagcttaccctaccttcaattacctggtcattgacccagccttgatcattacctattaaataaggatttcgagtattttttacaattcgagttatctttccaacattacgatatggccgtaacggattagaagattcactagttaaaaagacatagctaaatcttactgtatcacctaatttatattgttccactgctgtatcaatatcaaaattattcttacctgcacgtttaataatagctggaaaatcagcataacaataattcatatcaacaattgttggtaccccttgaacccatccagtcgaactatattgccacatatcatacggtttatcataatttaactcagcagcatagttagcaacccaccgtgtataattatcaaaaatcggatccgttaatttagtgttccaccagtatagtgaagcatacatcccaacataatatccattggcttctaattcatcagcaaatgttttagcgatatttgcaatcacatcatttgattgctttccagtcgtattattatcttctaaatcataatacactggatatgccatcttatagtttttcactagacgtaaaacatgttgtgcttcccctctagcatcactactatttttagcatatgaatataagtaaacaccaaacggtattcctaatcgtgtacactcgtctgcatttcttttaaacaaacgatcatcttgatctgttcgatcttgaccaaaaccacatctaagaattgcaaaatcaactcgatcttgaacaatttcccaatcaattaccccctgatattgtgagacatcaattccatgtgtcgtcattcttccacctccattaataatatatgagcaattgtcaaaaatgtgtgactttctagacttttttatcattttaatgcgaaacaatgaatattatgttataatcacattggtatggattaaatacgccatctttaaaactgaatataaaactaaataatatatataaattggaggtcgatgaaatgaaaaaagtattcgtcactgccttaggagtctgtacaatgctttcattagtaactattcccactcctgttcaggcaactgatttttccgggcaagaagataagtacatgaaattatgctcatcttcaaatctttcaactaataacttgaacacttgtaaagaattcaatacatacttgaaaaataaaaataaagaattgaaatctcaagtaagtgattcaaaaagcaaagtatctgatactcaaaatagtttgaatagtatctcaagtgaaattagtgcattaaatgatcaaattgctgaaaaacaaaaagaaattgaatatttacaaacttcaatttcaaatttagaagcaagtatagctaaaaaagaagaagaagtaaaagaacgtatgtattcaatgcaatcatacaataacaataattcatatattgactttatcttcggggcttctagcttcactgatatgtttgcccgaattgacagcgttaatgaaataacatcatatgatgatgaattagttgcacaactagctgatgaaaaagaacaagtagaaacacaaaaagctacggttgttactgccaaagctaatattgaaagtcaaaaatcatcaaagcaggcactacaacaagaatatcaagctctatttgaaaaacaaaacgctgatttgattgcgcaagaaaaagcagctgctcaagcggccgattcaagtcaaaaaatcactgataatatcgctgcactattagctgctactgaaaaatcacaagtttctggcggaagcgttgtttctggtgattctgcagttggaaacgcaattgcacaaaaggctttaactcgcgttggttatatgtatgtatggggtggatgtcacagcatgtctgaaatcgctaatccaaaccacactgcatttgactgctcaggtttagtcaactgggcttattatcaatcaggtgtcaacattggttctaataataccaaatcgctagctagtaaaggtgtatctgtttctcgtaataacatgcaggccggagatatcatcttatttagcagtaatggaagtaccagcggaattcaccatgtcggtatttatatcggtggtggtaacatggttcatgctccacaaacaggtaaacctgttcaagtagcggatcttggttattcatattggcaaaaagaatggtatgacgttcgtagattgtattaatacaattagatgagcaagcttgctcatcttttttatcacatatatatgaaattcataaattaatttcattatttccataacaaatgtgatgttttttagaaaattagctttatatccttagaaaaaatctaaattagtatttacttattaagaaaaatataggataattactatgtatcgaggtgattgtatgaaaataaaaaaagttatatctacagctttaacgctgacaatagtaacaagtgcatgttattatgcagcccctgtggcagccgatgaatttgatggtaatgaaagtaaatatatgacattatgctcatcttcgaatttatctagtagtaacaaatcaacttgtgaagcattcaacaagtatcttaaaactaaaaattctgaattaactaaaaaattggccgaacaaaaagaggctgctagtgacactaaaacaacactagaaagcgttcaaaaacaattagatgaagttaataaacaaatcagcgataaagaagctgaaattgagtatttaaatacaactattgccaatcttcaagcaagtattgaaaagaatactcaattattaaaagatcgtatgtatgcaatgcaatcttatgcaaatgaaaatacatatattaactttatttttggtgcaagcaacttcacggaaatgttctcaagaatcgacggttataacgaacttacacaaagtgataaagagttgattgaagaacttaataaacaaagaaaagaagttgaacaacaacaaactattttagaagaagctaaagccactttagttattcagcaagaagaacaaaaaacattaaaaacaaaatatacagctttgttagaggaacaaaacaaatcaattgcatctactcaaaacacgatttatgattatggtgaaatgactgaaaccctggatgctgcaattaaaaaatttaatgaagaagcatatgaaactccaactcctacaccaccgcctccaaaacctgataatggtggaaacaataataattccggtggtaacaacaacaacaataacaacaacaataataacaatagcgattctggaaataacaacaatggcggaaacaataataatgattctagcacatcagataatcttggtgaaaaaatctatgctgctgcttatgctaaattaggatcgcgttattggtggggagctcaaggtcccacatactttgactgttctggtttagtatattggtcattaaaacaagcaggtgttagtggtggtcgagatactgctgctggttactccagaaaatggtcagctgtaagttttgcaaactctaaaactggtgatttagtatgttttggtagtccagcttatcatattggaatcattgttgtaaacagcgatggttccagatcaatggttcatgccggtggtggtgattcatcaacacacggtgataatccaaaagcttatgttaaagtatcttcaattgaaccaggatcatattactatagtagaataagtacaattagacgtgttagtaaataatagatattttaaaggacaaattttgtagttcactacaatacttgtccttttttattttaggcgataattatccaaataatatatgatcgttatgttatatttatatcctatttaaaatttactatgctataattaaagttagaaaacaaaggagggaaatgagcatgaaagcaaagataatatccctctttcattacttattagtctttttattaataatttttaataccagctgtcaagctaaatcaataaatattgttgatacaaataataatgatcagattgaactaaatttttatggatataaaacggaagcaattaatgttgttgcaatcgaagaaattttacaagcttatatggataaaaatcccaatattaccattacctatgaaagtgtgaaaggaactgagtattatgagatactaaaaaaacgtttggcctctaataactatgatgacatttttatgatcgatgaagataatttacagcaattaactaattataattattttgaagatttatcaaagctaaaaacaataaaaaactttaacacaaactcattggaacaaatggtgcaaccagataatacgatcccctatattccaacttctatttcagcatttggattatattgcaatcttgatttactagaaaaacatcatcagtcagttcctaaaaataatcaagaatttatggctgtttgtcaatattttattgagcaaggaattactccgatcatcgctaataatgatatttctctaaaaacaattgctcttgctaaaggtctttatcccatctatcaatcacctgaaaaggatagaataatcgcttcactaaatcaagatcctagcattctttgtaattatcttaaagaaggatatcaatatgttaaacagttaatcgacaataaattcattgatgcagccacaactttaaaaacagaaaaaactgcagacgatctaatacagtttgaagaaaataaaaatccttttatgttaactggtgcctgggcctctgttcgagttgaaaaaagttcaccagatttaaattttaaagtttacccttatccaattttagacgatggagcaattctagtttcaaatattgatacccgtgtatgtattaatgctaaaggtccacatattactgaagcaaaaaaatttattgaatatttaagtcaagaagatgtgatgtggaaatttgtaaatagtcagtcctcttttagtcctctgaaagaacaacgtattgctgatgatcctaagattcaagaattaagcccttatttaacctcagagaaaacaattctaggcagtgattcaaatataaatcttcccctttggtcacttacccatgacggaatcacccaattattaacaggaaacagtattgatagtgcattagaaataatcaaaaattatgaacagtgaggatgattccaatgaaaaataaaaaaatatcgttaatgattgtcaggggaattagtgctgtgatttttgttgttttttccatgttcatttatgttaattatgttcaagattctctttgggataagtcaatcaatgatattttagaaacaacctctcaggaggaaaaagcctttaatgtctatatgactaaagaaatgactaactcccaaaacatccttactaatattgcctatctacaaactaagattccgcagtatctccagcatctatctaatcgtgaagaagctaaatatttatatatcgactataccaatgactgctactatgatgaaaatggtaattatccgttaggtgatgaacagttgtttcagcaaataaaagctgataataattcacaaggatttttagagccctatcttaattcaaaaacaggtattaagacttttgcaacttatgtaaaaacaagcgatagtcaaagtgtcattgtcaaagaaactcaattaagttttattattgaaaacttctcactttcgttttataacgatttaggtttttcatatattgttaaagataatggtgaaattttaattcgttccaaacatcgtaactcaaatcgtacttttaaaaacttatttgatttaatcgatctgtctggtaatgatgcaaaaaccattgaatcatttaaagcatctttatctaaaagagataaaggtgttgccttatttaattatcaagatagttccaatgtattttgctatgttccattacaacaaaacaatcactggtttattatttcaattattcctaatagtgtaatcatgaagcaggccaataacattattatttcctccataattttatgtagtggtattgctggtgcaatcagctgtgttgttttgctatatatccgtgatagccgtaaacacaaaagaatgttagagaacttagctttttatgatcatttgaccatgctctataattatcaaaagtttaaaacagagggggaaaaattatttttggaacgtaatcatactcttcttgcagttctgtatttagatattaatgactttaaaataattaatgaattatatggttataaatatggtgataagatcttaacgcagctggcaaatattttaaaaaaattggtcatagccccaggacttacgtgccgagtaaatgccgataattttttaatcatgcagtcatatcatgataaaaccgaactggaaaacttatgccaagaaatcaatcaaaaattttgtaatcttttagaatcacttgataataaaaataatactatagttaaaattggtatatgctgctatgaagatgatcaaacaatctcaggtattgatggtctaattgactgtagtcacctcgctttaaatgcatatatacctggccaaaccaataactattacttctataattctaaaatgcatgatcaaatgattagaaaagtagagattgaaaataacatggagtccgctttactgaataacgaatttacattctatctacaaccaaagtatgcgccaaatggacaagtcatgttaggagctgaagctctagttcgttggcttgagccatcaggaaatctcattatgcctggtgaattcattccaatctttgaacaaaatggctttattcttaaaatggatgaatatatatttgaaagtgtttgtaagtttctctatcaacgaattatcgaaaacctgccaaatgttcctatatcgattaatatttctagattacatctttatcaagatgactttattgaacgctacagtaaaataaaaaataaatatagtttacctgataaattagttgaattagaaataaccgaaaacattttacttgataatattgaaagaattagaaacattatcattgaactacaaaataatggctttacttgttcaatcgacgattttggttcaggttactcatcattaaattctttaaaagacttaccatttgaagtcataaaattagaccggcttttcttaatcaacagttatgatattcaaagaagtcaagaaatcatcaaagctattgttgaaatggctaaaactattaatattaaaacagttgctgaaggtgtcgaaaccccaagccaattggaatttttaaaaatgattgattgtgatatgatccaaggatatatcttttctaagccacgaccaatcaaagaatttgaacaactgcttataaatcaagaaaaataactttttaattagattcctatttttagagttgcagactcgaaagtaggaattttttaacattttcttagatatgcacccaaaaacagcgtattatctttatttattgagttagcaatatctcgctaaatatcatataacaattattctttccatagaaacattttttcaaaaaacgatcaataatactctttatctaataatattctaaaatttgatagtacaaagaaaacttgttttcaaaattattatcccttcattataattataaaaggtttactacatcataatatcatcaaatcaatctaataaaatattcgttattcatatcaataccatctttttcatcaaactgtatacttttctataactataacgtcaataatttttaatatttatattaaatagtctttaaaattagcagcttttaaagaccagatattttttattttaattgaaaacgataacattgatattagagatttaataatttttattttagtgctataatctacaagaaaagagggatagtgtgaagtatgtacatcaatttttaattattatgacaatctcatttattggggaattgttgggattgttattgccattgccaataccggcaagcgtttatggtttagcaataatgctaatttgtttatttactagagtaattaaattaaatcaaatcgaggaagtagctgattggctgatcttaatcatgcccgttttatttgttccttctgctgttagtctaatcaacgttggtaatgctattattaaagatctcctagttattggaattgtcactttaattagtaccatcgttgttatgatcgttacaggaaaagttgcacaagtaatcattgaacgaaaggaggataatgataatggatagttttttgcttgaaacagtatattttgggattgttatcagtctattatcatattggattgcagttcaaataagaaaattattgccctacccaatttttaatcctttattgatcagtgctgttatttcaattggtatattaatcatttttgatattgattttgatacatataataagggagctcaattcattacttttttattgaccccagctactgtttgtttggcggtaccactttataaacaagtgcaaatattaattaaacatttagatgctattttaatcagtttatttagtggttgtcttgccggaattgtttccatttttataatgtgtttaattatgaaagccgatcctgtaatttattattcacttttaccaaaatcaattacaacagcaatcgcaattggtgtttctgataaactaggcggtaattcaaccattacagttggaattgttattattactggtatccttggtgctatcattgctaaaagtatttgtaaattatttaaaattaagcatcctgttgcaatcggtttagcccttggtaatagtgcccatgcgattggaacatcaaaagctttagaatttggagaaattgaaggagctatgagtagtttatcaattgttattgctggattattaactgtaatcattgcaccattaatggcaaatttattataaaaaataaccctttattcaaataaaatgatatgtactggataatccatatcaaaacgagtaaagggatttctttttattatatctgactatatgtctctggactttctaagcgctcaaccaaacgctgtaatgattgctcaaaccgatcagtaaatggttcatcaaaataaagataaccattttcatagtcctcatctacagctgtttcaacaactacagtaagactttgataaacgctactaagattttcttttatatattttaattcctgatgattgtattcttcaataaaaatataatgatcacaaacctctaatgcatatttaagttcatcattaaaattatctttaataatttcatgattaagaattccaacttgaaacccacgaatctctaattctaaagcaaattcatttatccacattatgttacttgtattagttaataaagtaatatttttttctttattttttaaagttagattttttaaatcaaaaaaaacttgaagtaaatgccgaaccaaattacattcagtaattatacttgtatgttcagctgtatatttctttattttagggtgtgcacgtaaatcaattgcttttaaggcttgggaaagttcaaaatatcgatcgactaagtcctgttttgtaatattgttagtaatgctattgacgctaaaaaaatgataattagtatatggtaaaatatcagtatcataaccaaaagccacttttgctttaacccctttttcatcccagccaataaaccttccaattcgtcttgctgcttgtcctgagacgattttaacatatccaaatttagccataattaatactcctctttctttataatttcttagcagcattaaatattcattttaataactattttcaatgccccttattcgcttatataaaaattcatttgttggtacttttagtttatgctttgatgccaaagaaattactgttccagcaaacatttcaactttactgtaacgacgtacttttgcatcttgagccattgatggtaaacccagaggatccaaagtcctaattatctcaatataatgcttcaaatccgtttcagttagatcaactccctcgtaatgtgacaactcaataatttccttcattgctgcaatcaaggtatcatttgcttcccccggcattaaagcaccactataattggtattatatgccatacaagtctgatttatcccaacattcaacatgaatttagcccacatactatgtaaaatatcgcctttaacttcataattaatttttgcttgatcgaagaagctagtaagcttatccaacttatctttttgcttgaaatcagtgattcccaataagagctgtccttctttagtgtactttagagatgttccaaacttcattgcatccattccctgagcaaccgcataaattactttttctctcccatagtattcactaataaccttttcactgtcaatcccatttaaaacagaaattattattgtatttttatcaacacatttcttaatttcctttattgcttcctctaaagcagtcccttttactgctatgattattaaatcaaatggaacggcattaaaatactcaactaaattaaataaaactttctcaccatttattgtaaatacagtttcctgatatgcttttttccttttttcatcaactataaatgtcactgcttctctagtaatgttttttgcaataaaatctccatataacattcctaaagcacccatcccaataattccaactcgtttgatcacaataatatcctccataagaaaaaagctgatcaatgaccagcttttgcatcaagtttcaattaattatttagataattcagcgaaatatttgattgttctaaccatgttagaagtatatgaattttcattatcataccaagcaactgtttgaacttcagtagttccgttgtccattggtttaaccatagtttgagttgcatcaaataatgaaccatagttaattccaataatatcagaagaaactaattgttcttcagtatatccaaatgatggagtagctgctgctttcatagctgcatttacttcttcaactgtaacttcaccttcaacaactgaagttaagattgtagttgatccagtaggaacaggtacacgttgagcagaaccaattaattttccgtttaattcagggataactaatccgatagcttttgctgcaccagttgagttaggtacgatatttactgcagctgcacgagctcttcttaagtcaccttttctatgaggtccgtctaataccatttggtcacctgtgtaagcatgtactgttaacatgataccagatttaattttagctaagttatttaaagcgttagccattggtgctaaacagttagttgtacaagatgctgcagagatgattgtatcatcagcagttaagatattttcgtttactccgaatacaactgttggtaagtcatttcctgctggtgcagagataacaacttttttagctcctgcatcaatatgagcttgagatttagctttagatacatagaaaccagtacattctaatactacatctacaccgatttcaccccaaggtaatttagaagcatctgcttcactatagattttaatttcttttccatcaacagtgattgaattttcaccagcttcaactttatcagctaatgcatatctaccttgtgctgaatcatattttaataaatgtgctaacattttaggatcagttaaatcgttgattgctacaacttcatatccttcagcaccaaacatttgtctgaatgcaagacgtccgatacgtccaaatccgttaattgctacttttactgccattctttatattcctccttgaatgttctttatgctcatattatattccagaaaggcaagaaaagcaactaatgtaacgggtttcattgaaaaaaattaaatatttcacaaaagattcataaatttaactttaatggaacaaaatctaacattattcttttataatataaatttagtgacttttataagcctagttttaccgcaatctttcttgccttttataggcttaaatgaataattattattttaattactatacttaaatgtggaggtaagataatgcatttagttcctacagtaattgaaaaaacaaaccaacgtgaatatgcttatgatatatattcacgactattagaagaccggatcatcttattaaccggtactattgatgataagatgtccagcagtattgttggtcagcttctctatttagaatcattagataacaatgctgatatttttatgtatattaattccccaggtggcagtatcaatgcgggaatggcaatctatgatacaatgaactttatcaaatgtgacgtttcaacaatcgtaattgggatggctgctagtatggctgcctttttactcagtgccggagctaaaggtaagcgttgtagtttacctaatagtgaaattatgattcatcagccattaggagcttttgaaggacaagcgagtgatattgaaattagtgccaaacgaatcttaaaacaaaaggaaaaattaaatttaattcttagtaaaaatacaaatcagcccatagataaaattgttatcgatactgatcgtgatcactttttagaacctgatgaagcgcttgaatacggcttaattgatgaagttatttaaaacgaccaacttatgaagtgaaccccaaaaaatgatgtgtacccagttttctggacacgtttaaatttagttttaaaaaaattatgccatggatgctaatctgtacaaaacaggtggcatccattttgttttttctgtattcttttattgcagtagaaaactatgaaaatgaatacaattcattttcatacccataatagacttcattttttaatcggccaaagaaagtttccattaccgaattatcataacagtttccttttctagacattgattgtattatactgtgttcttttaatgaattgatataatgagcatgttgatatttccatccctgatctgagtggaaaatcaatccttcaaggatggaaaacttttcatatgcctgagtcagcatatttgtaatttgtttaagattaggatgcggtgataaatcataggaaataatctcatttgtaaacctatctaatattggagaaatataacattttccccatgcaaaattgaattgagatacatcagtagtccatttttgtaatggtctactcgtattaaaatttctattaataatattatctgctacattccctttataagaatggtatctctctttaggacgtttacctaataatcccatattatgcataagtcgttacactctcttatgatttaccagataaccgcgatttagaagctctctatgaactcgacgaactccatagcgtcccttattttgatcaaagatttcttttatcagtttcatcatctcatgcctttagaagatgctttaatcgatatcctttttcacgaatttctttaacgattgctgctcttaaacgtattagttcttctttctcaggaggagtaagttcacttgatattatagattttttcagaggctgctccttactatgtcgtcccttctttaaatcgagaccattatatccatatattttatatcgttttacccagtttgacaattgactgtgattaatattagcacttattgcaacactttttttgagattctccagctagaaccctggcaactaaagttgtatctttcttccacagtatactcagtgcaggtggtaggatgttttaaagcatctattccatgtaagtcagcgattttgacccatgtagtaattccttttctaaagtttttttgtccaattccttctggtgtttcatgccatcgaccatttttatatagttcaacacacttcaacttaaatacataatcatatttcatataaaaaccctccttactggtttgcccagtaaagagggtacgcatcacaaataatggaggttcattttattatcagttagtcattttttaatatataactgtctagatcaaccaaatatataaaaatcagctatcctaaaatataaaaagaagggaaacatatttcccttctaaatcaaactattgtctttaaaatctattttcatttaataatttgtacaagctaaataatcatactatttttgaattacgatattgatatgctaataaacctgttaataatagcattccacctggtagccaaaatactacaaaatgataccactttaattttaatcccttaaacttattcagcatcttatatcccctttatcaatctacatataatataaggagataatcacatattgtcaacataattcggcataatttagatttattaagactttaatttttttaccataaataccatgtcatcattaatcttaaaaccatttttctgataaaaatcagcactgtaaaattctcgtcctgtcaacaaaattaaattatcaacttcaggtaaacattcttctaatgccttcatcattttctttcctaatccccttctttgacaatgaggatcaatataaaaatcttcaatcataaaatcaagatcattaacatatgttattaatttcccacaaacaacaccagctattttgttatctaacatatacacaaaacaccttgtatattttccgtcgtctaactgttcaattcgctggtatgatctttcataactccatacctcattccaaggaggatttttaaatgcttcaaccatcagtttagcaatctcttcatagtcatttttagtgacacttctaatcatctaaaatctctcgctttccacaaacacaataattactcttaaatcgttctacagtatgaactacttctttagttaaaaaatcaataagtctttcatccaattgatgttcttcaaaactactttggttaggataaatgagtttaccaggaaactttgtttcaaagaaaattgtatttaaaatcgtaatgctttcaagataactccctaatgaagttaaatgctgattgtcactttggaacaattctaattcgggattttgatggcttaaacgattaatgacataacccactggtattccatcaactaaattatccatcattacttgatgataaatatctttggttgttttaaaatcatcatcataattccgttggctccaaggaatcataatgtatggcataacaccacagctacgtgccaattcaatcaatgctttagcatcatgcaatgttgcttctttacttggacaaggctcatgtgctgcctgttgaaaaataacaaaatcatatccttgttttaaagcgaactgtaattccattgactctaaatggtcgtgaaaggtaattgcaggacgggccaacattgtcacttctaacttttcactactattgattcgcaccatttctggcatatcattcatatacgtatgcgaattcccaacaaataatattttcatcctaattccacctactttcaaaggactactcctttagtatagcttcaattacgactacttagcaatctttttaaaagtaattattgctttaaatagatccccatcgattgcaatattaaaagtccccccctgtgcttcaacaaaacttttagctattgctaatcctaaaccactgccactttcatgacgcgatttatcaccacgaacaaatctttctgtaatttcttgaggactaaaattcatctgctcttgtgaaatatttttaaaaataatagtaatatcctcagtttcctccgttaaatcaacatatacacggctattaaatagagcatatttagaaatattagtgaatagattctcaaaaatacgatacgtcttatcaccatctaatttgaggattatatcattatgtggataattagtaataacagttaattgatgcgcatctaatatttcactacattcagcatgcgcctgctcaattaatgcaacaatattaagttccattaaatttaacttgatattaccactattaactttactaacttcaaataaatcttcaattaaattcgttaaacgattagaatactgatttaaattatctaaatattcatgtcttgtctctattggtaaattatcatcttgcaataaaacaatataatttttaatacatgtcaatggtgtttttaagtcatgagaaacattacttactaattcatttttcatattctgagacttagtttcttctttaacagcagtttcaaaaccaattcgaatatttttaaattcatcatttaaagcattaaaaatacctaaatcaccatctatctctacatcaaaattacctttgcttaattcttttgttgcagtcaataatttatcatagtcatcttgcaccttcagcactttatctttgacccaaaaaaatactaaaaatgcataaataatagctaggaaatatccaaaaccccaaaaagtaatcatgatcataatgattgctgtattaatcaaaatatatttcatgattgtttgatttaacgactttgatagatcaatatcggcaatttgattaagtttatttttgatactgcgtactccactaccaattaacgtatcttcttttaaataacgccagaatcctcgagcaaaaatgtactttaattggaagattcctaatgaaataactaaaagcgtcagtatccaaatcacaaaattaataactataacgatgtaatctacatacatgatgtcatatctttttaataattctaaaagtgaattattaagtgtataacccgtcacgatcatacagcccataacgccaaaagtaatcataagcgttaaaacagctagatttatttctgctttccatctctttactgacaaaaacggattaacatcttctacaattttaattggataaaataagataaataagactaatatagctgaacaacttaataacgcaatagctgaaaaataattatagttttcccatgaattaacatattgtgaagcatatccatgactggctggtgtttctggaataatatatgtaatttgaagattcttaggaacattaatcttgattgcatttgtatcaaacatccagttgtcaatatatatagtattttcaccatcataatgtgcaaatgagcttaaaaggttagcaatattaaaatatgatagtttatcactacttaaatccccattacatgaaactagaccattttgatcatagctcgcctcagtatagaaactatatttactttgatcatcattagttgtaattttttcactatgttgcgaaatcatttgattagtattagtattaacagctttataaataaaatctccatcattattaaacaatgatgttattccctttaaataatcgtcaaaaacatctaaaaatatttgtcttgtctgttcatcaacactatcatcaaagcttactgcttcataattagaatcaagggtcttagccatcgcaatagtaaaaagctgtagatcatcttctaaaattcccgttaaattatcatcacgaggggtattttctctaacattatcatataaggatataacaacaacggacattaatagtaatattgatgcaaaaatcacaccaaaaattcttttagcttttgtcattttttacactcctttttcaattttatatcctattccccaaactacttttaaatattctggttttttaggattagcttctattttctcacgcaattttcgcacatgcaccataattgtctcagtatttatggcttcttctttccaaacagcttcataaatctcctcagctgaatagactcttcccggataagacattaataattcaagtatttgaaattctttagccgttaaacgaacacctcgatcattaacaaacacttctttagtaaacttatccagctctaatccacccacgactaagcgctgttgattattattaagattacgattttcttttaaagctaaaatttgattatatcttcgaagattcgaattaactcgagctatcaattccatcgcctcaaacggcttagtaatataatcatcaccaccaatattaagcccggttattttatcaatatcttcagactttgcacttaagaaaataactggaaaatcatagttttctcgtagttttagtaccattgtaattccatccataactggcatcataatatcaaccactgctaaatgtatttcatttgcttcgattaatgctaacccttcttcaccattactagcttgtaaaacattatatccttgattcttcaaaaaaactgttactgtttctctgattcctttttcatcttcaacaattaaaattgtatgttccataatcttctccctttttctaattagaattaactatttttttataataaacggcaccggtaattactagtataacagttaccgcaaagattgaaacagccaatacaatattgccgtctcttaatgctcccgttaaatatgtagatgtcacaatacttggaattcttccaatcgttgtaagcaatagccattgttttatatcaatatctgttaagctaactaaataagtcataatatctttaggacttccaggaatcaaaaaaataataaatagccaaaacttactttttttagaagaaaataattttttcacttctgcaactttactttgatcaaacattttatcaatgattgagtgttgaaagattcgtgctaaatagtaaacaataatcgttccaatcattgacccgatcaaacaaacaattgttccttgaaatgaaccaaaaatatatccactagccagctccaaaggttctccaggtaaaaatgctaaaaagatctgcagagcaattaaagcaatcattgctgaaactttagtaaaatatggcagtgtttcaatctcataaataacatcattaaaatcgcagtttctaaataaatatattgtaataaatgccatgaacaaaataattgatgacatcatgagcaaatttgtcttttttattgatttaagcataagtcgttccgcctttctatacttaaataataaaagactatcctaaaactaaactaacaataattcttaaaaaattctaaacaaaaagcaaaactttcgttttgcttaattataatcatcttcaatcgtagaatcgacatcctcttctaattcttctgtttcttcttcatcagcataaatatcattcatatcaatatgaacatcactaaatttatgacgacttcttaaatcccaggcattttcaccaaccgtgataaaacgtccgtctaaggtaatattagtataaaacaaagattctttatcttctttttgttcgtcatcaaatttcttcatttgacatacttcttcccataatttgaaaaaattaactgctgatttctttttagacattaattcatatgctacatcaaccatagacatattataatatttatccatactatccattcttgattatcctcctacatcttttctggggcactaacaccgattaaatttaaagcattagccattgtaattcttgtagcttcaactaaagctaatctttgtccacttaattcaagattatcttcatcgattacataacattcattataaaaactatggaataattgtgcaagtctttgaacataatttgtaattttgtgaggcgtacgattgatcgcactatcaataattacgtttctaaactcattaatatgctttactaattcaatttctttaggattaactaataaatcatacttatcactataatcaatgtttgctttagcagcctgtgctttaatcgaacacattctagcatgagcgtattgagcataataaactggattttcattagactttgatttagcaagtccaatatcaaaatcaaatggtgtattagcagctttagaaacaaagaaataacgcgtagcatcaacaccaatttcttcgattaagtctttaatagtaacagcatttccagttcgttttgacatttttactggttcaccattattcatcattctaaccatttgaataatatcaatatttaactggtcagcattataacctaaagcttgaatagctgctttcattcgattaatataaccatgatgatcagcccctaataaatcaactaaatattcgtatccacgatctaatttatttagatgataagcaatatcaggcgtcaaatatgtatacgatccatcacttttaattaagacccggtctttatcatcaccaaattcagttgatttgaaccataaagccccttcttcttcatatgtataaccagcagcttttaatttttcaattgttggtacgacccgatcattttcatataatgatgtttcagaaaaccaaacatcaaacgacactctaaattcatttaaaatatctttaatcttttgtaattcatattctgttcctttatttctaaagaaagcaattgctttaccttcatccatttcaagatatttatcaccatcgatctctttgatctttgttgcaatatcaataatatctttaccatgataaccatcttcaggcattgtaacatcttgtccaaatgcttgtttataacgagcgtatagagataacgctaaattatgaatttgattccctgcatcattaatataatattcacgagtcacatcatagccagcagcactcataattcggcagatactatcacccactgctgcccctttagcatgtcctagatgtaaatcgccagttggattagctgaaacaaattcaacattatatttagttccttgaccatatgttgtggtaccatatgcttctttttcttctaaaacttctttaatgattgatgtcattgcatcttttgccaagaataagttaataaatcccggtcccgcaatctctactttttcaatattggcattttctttatctaaagcctcaataattgcctcagcaatttggcgaggatttctctttaataattttgttagctgcattgctagattagttgaataatccccatgtgatttatctttaggaatttcaattgtaatactttcttgatcatattcttcaacaaatccacacgctattattgcttgtttaagcgccccttttaaagtcgcttcaattttattaattgccatcattgccctcctatcttctaatcactatatcttaattaaattaccattaaaccctcatgaagtcaatgtttttataacaatggtgcaaataatcttaagattgcttctagccaccctctaaagcgccctttaacgacatcttcaggggtcatttccttactcacagcgatcgttttcaagaagtcctctttaatatctttaattgctggaacatcatacatatagactccacattcaaagtgcagataaagactgcgataatccaaattaattgttccaacagtagcaattttatcatcacaaacaaagttcttagcatgaataaacccaggagtatactcgtaaattcgtactccgccatttacaagtggttcatagtaagagcgtgttactttaaagaccatttttttgtctggaattccaggtgtgatgatccttacatctactccccggcgaacagctaaacacaaagcatttttaatttcatcattaatgattaaatagggcgtatcaatataaatatatttttgtgcttgattaatcatatttaaataaacgtttttccccaccggcttattatccaatggtgaatcgccgtatggtaaaatatacccatttggacttatttcgggacatatataatgacgaggatgatatttatcataatcttcaaatgtatttaatgatgcattccacgttgttaggaacatcagtgttaaattccatacagcctcacccttgatcattacccccgtatctttccaatgtccatatttcactttagcattaatatactcatcagccagattaaaaccaccactaaaaccaacatttccatcaatcaccgtaattttacgatgatcacgggtattcattactgccgaaataaatggaacaaaatgattaaatgctatacacttgattccataactttccaatttttgataataacgaaatggcagcattgtcaaagagcccatatcatcatacataaaccgtacttccacaccctctttaactttttgctttaatatcgttaagactgtattaaacatctcaccttcttcaacaataaaatattccataaaaataaaatgttttgctttagctaattctttcaacaaatctggatatgtatcatcacctaaagggtaatatttaatctcactattattataaataggaaaattttcttgaactaaataattagcttgtccttttgcaatcaaatcctcaatttgttcaaccatcttatttggataaataaatggtctaatagcttcttcttgattagcaaaggcttcttgaagctttttagctggctttttattaccaaaaacaacatacaacaaaccaccaaaaaccggaaaagataagatgggaattaaccaaataatcttataactggggtcatcatcgtcattgttgataatatataaagttacgatcacacttaaaaaaataaaaactccttttaataaggtcgcatcagtaaaaatatagcgcataaataaagctagccataatatctgaacacatattaaaataatcgatacaacgatccggtttgataaaaactttagtattttcatcttagttctccaatattaaataattgagcatgacatatacttgactaatcaaattagttccatcatataattcatactttattttcacattatccccgttatcataactaattaatctagtttttaaagcaattgctccatatggagtttcatattgatttaaaatatcacgatctcttactaaatgcaaaacactagccccattatgaagtttaacttcattttcacttaattcaatttttattttattttcatcttgataactgactacaattttatcatcacctatctccagatgaccagaaccatcatatttaacagtttcttgatgttcttcatatttaaaaatacttcgataatttactttaattatttttttcattctatcaccgtgcatattataacacaaatccgtcaagaatacttttggtgatatgatgaaaaaattagtaaaaatatttgtaactattttagcaagtttagccggcatacttctatcactatatgttattgcatattgcatgggggaaccggatctaaacaagaatcgttatttaaaattatacgatgataatcaagaaatttattatcagtcgatcaacgactataccggtcattatgtaactttaaataatgttagtaattattttaaagaaagtattgtagctattgaagatcaacgcttttatgaccatcggggttttgatccaattggaatcatgagagccctcaaagtaaacttcacaaatcaaaaaaaatctcaaggagcgagtacgataactcagcaatatgcacgcttattgtacttaactaacgaaaaatcctggtcgcgaaaaattaaagaagcttttttgacaatgcagttagaaacacgtttatcaaaagatgaaattctcgagggatatattaataacgtttattttggtcatggaatttatggtattgaaaatgctgcacaatatttttatggtaaaagtgctaaagaactagatttaaatgaaagcagtatgttggctggagtagttaatggcccaacctattactcacccttaaatgatgctaaagcagctcgaaaacgacagtcaatcgttttaaacgctctaatcgactgtaaggaaattaccgtaactcaaaaacagcaggttcttgatagtgatcttaatcttgctgaaacgcataaagtagatgataatatggctaataattactataaagataccgttattgatgaactcgaagaacttggttactacaacaatacatatttgaatcaaggtttaaatgtgtatacaagttttaatcaagattaccaaaaagtagtggaaaaaagtgctagtgaatatactaaggatagtaaagtcgaaacctcgagtatcgttgttgaaccatataccagtaaaatccttgctattatcggcggtaaagactatgccagctcacaattcaatcgtgccactcaagctaatcgacaaatcggcagtacaatcaaacctttgttatactacctggcgctagaaaacggtttcactccggcaaccacatttttatgtgaacctactacctttaaacttgacgataacagcacttacagtcctagtaattttaacgataaatatgcatataaagatgttacgttagctcaagctattgctgtatctgataatattttcgccgttaaaacacatctatttttaggaactgataacttagcttcattaatcaaaaaatttggaatcaaggacgtcaaagcaaatgcctcactggcacttgggactttaaatacaaacatatataatcttgccaatatgtataattgtctcgctagtgaaggaaaatacaatcatctctatacaattgaaaaaattactaatgatgctggtaaagtcctttaccagcacgaacaagaagataaacaattgctggagcaagatagttgtttagaattatcacagctattaacatctacatttaatagtacatttagtacctatcttcaagcaacaatggcttcttatcaacttgataatatcaacgcctgtaaaactggtagtaccgatgttgataacctggctgtagcttataatccacaagtcctggttgccagctgggtcggctacgatgacaatcgtaaaatggaaacagctgatgacaaaactgttgctaaaaaaaccgttatcgatgttttaaactataccaatgaaaacaaagatgttacatggtatcagccaaccgaagacctacagcaaattgcaatcaatccactaaccggtgattttgatgaaaatggtacagtctattggtttaaaaaagactaatcccgaagtttacacttcgggatagaaaatcttatgatcatttttatttttcttagaatttacaattgccccaacaatttctgatacttctggtaaaaaccggagttcttcatcaattaatatttcaatttcactgagttcttcagtatttccataataacgatagggaacttggctttgatcatcacttacaacataataacgaggatcatagccttttttttcataaaatgattcagctaattgtttttcatgttgatcgagcagatcatgataaataaacaatcgtcgatctaaaaagcgtgtacataaatctttcaaaatctcgtcattgccttcttttaagactgtaaaataataaaaaacgatcccctcatctaatttagtataatcattttcatcgacatgtccatcaagaaacggctttaaataacgaatatctccaaaatcataaccagctgcataaagatctttcattctcctaaaaatactaattaatacctgttcataactccgggctgtggggtgataataaacttgccaatacatatgatatctggctaaaatataattctcgattgcttgtacaccagaattcttaaaaacgatctttccatcacaaacagccatcactcgtaaaattcgggataaatcgaattgcccataagtagtaccactaaaataagaatctctaagtaaataatccatccgatcagcatcaagttgactcgaaaccatctgtactaaaattttattaggatgtgttttttcaataacactacttactctatgtgaaaaaccatgatcaaatttttctaaaagatcatgtacttcggtctttccgttaataattttaattgtatatgcttcgtggtttaaatcaaaggcatcttcaaaacaatgcgaaaatggaccatgaccaatatcatggagtaaagctgcacacattactgttaacttatcataatcatttaaataggctccgattgcactattaaaaatcatttttcgagcaataaagtaaacccctaaagaatgacaaaaacgcgaatgttccgcactttgatagacctgatgcgtcccgcctaattgcttgattctccgaagtcgctgcatttcatgactattgattaaatctaatatcaatggttgatctacatgaatataattatgtactgcatcacgaaaaaccttactatctgttaatttcgtctgttctaatcgatatgccgcttgattcatcagtcttcctcctcgtactcctcaaaacgatatgtttattctacatttgggtacttctttatatcaacttttgataaaaacatttctaaagaacgaataaatattttttatcatcatacatagcttgataaataacaacttcctccaatgtttcactatctaacccaatattcataacataatatagtttgcctttgaaatgtcgatataaatgtcgagtctttaattttcgttccacgttctcaccactttttctattttcattataatacatcttaaaagtttatgctataattgagtctaggaggtatgacatatgtacattaaaatcaatgaagcaacaaactatattaagacccaatatcatggaaaaattgatttagcaatcattctcggttcaggtctaggcccacttgcagatgaaattgaaaatcctatcgaattagattatcgcgatatcccccatttcccgatttctaatctcattggacatgccggcaagttaattatcggtacattagaaaataaaacagtaattgccatgaaaggacgttttcattattatgaaggcaatgacatggatattgttacactgccaattcgtgtatttaaaagactgggaattgataatttaattttaactaatgcttgcggaggaatccgtgaagatttaaatcctggacaaattatgctgattaaagatcatattggtttatttgccccaagcccactacgtggtcctaatctcgatgaattcggccctcgttttaaagatatgagtgaagtctataatcgaaaattaggaaaacttgctcatcaagttgccgatgacaataatattagtttaaaagatggtgtctatgctttttttaaaggcccaatgtatgaaacaccagcagaaatattagcatatagagccttaggtgctgatgcagtgggaatgtccactgtaccagaagccattgttgctcgtcactgtgatatgaaaactctgggaatttcgttgatcactaataaagccgcaggactttcaaaccaagaattaaatcaccaagaagttgtagaagcggctaataaagcagaaaaagacctagttactttagtaaaaggcattataaaaaattggtaaactaaaagcatcatactaaactgaccctatagaaaacacatttatcgtgtttactctatagggaacaatttaaagatgcttttttattttatttgcacagtatttaattttcgattaacttcactaatgtctttatcatccatagcccgaagatacttaattggttgattggaatcataaacatctatttgatcgacccctaataacctatctccatcttcaccgtaaatatatccttgtcctgctaaatcaatgtttgattcatcaaaaacagaaacaagctcatatttgtttggatccttaaaaacatcatagtatctaactactgctttcacgacaactgccttaccaaccttttgatcatttaccctaatatgatttccttgataaaaatatactccctccagacgatatccatccatagccttaacttgctgctgtgcaaaatttgccgcccattccttatcatatgctattttttcttgacaggctgtcattataaaaagaaatagtaataaacaaataaatttctttaattgttgcattatcctctcctccacaagctattatatcataaaaatatttttttattttaaataatctttatattatctaagttctaatgatatttacaaaatctataaaaataatacaaatcctaataaatactagtcatttaaccgattaacggactaatcgtaaagctcattatttttaataaaccatgaaaaaatttcaagtcttgaaaaaacaaaacatttatttgaataaacgtgtatgctttatgtgtaaaataaatatacggaggaaataagatggaaaagaaacctgtaaaaattgtaacaattggtggaggtagtagttatactcctgaattaatggaaggatttattaaaagatatgatgaacttccaatcaaagaaatttggttagtagatattgaagctggtaaagaaaaactagaaatcgttggtgctatggcacaacgtatgtgggacgcttctccttacgatgttaaagtacatttaactttagatcgtcgtgaagctttaaaagatgctgatttcgttactactcaattcagagttggtttattaaacgctcgtattaaagatgaaagaattccattctcttatggtatgttaggacaagaaacaaatggagctggaggaatcttcaaggcatttagaacaattcctgtaatccttagcattgttgaagacatgaaagaattatgtccaaatgcatggttagtaaacttcacaaatcctagtggtatggttactgaggcagttatgaaatatggtaaatgggatcgtgtaattggtttatgtaacgtaccagttggggctatgatggctgaaccagaaacaatcggaacaactttagataaattaatttataaatttgctggattaaaccatttccactggcaccgcgtttttgatttagacggtacagatgtaactggaaaaatcattgatgcaatgtatgaaggtaaagattctggtattcctgcaaatattcatgatatcccattctttaaagaacaattaaaacaaatgaatttaattccttgtggatatcatagatattactatcgtcaacaagaaatgttagctcatgggcttgaagaatataatggaattggaactcgtggacaacaagtaaaacaaactgaagcagaattatttgaattatataaagatccaaatttaaattacaaacctgaacaattaactaaacgtggtggtactcactattcagatgctgcatgtgaaactatcgcatcaatctatgctaataaaaatactcaccttgttgtaactactaaaaacaatggtgctgtacctgatcttcctgctgactgtgctgtagaagtatctgctcatatcggttcagctggagctttagctatcgcttttggaccattagaacctgctcaacgtggttggttacaatgcatgaaaaatatggaattatgtgttgaagaagctgctgtaactggtgattatggattagctttacaagcatttatcttaaatccacaaattccttctggtgaaaatgctaaacgtgttttagatgaattattaattgctcataaaaaacacttaccacaatttgctgataagatcgctgaattagaagcagctggtgttacagtaaaagatgaaatcgctagagatttagactaaataaaaaattcgtgaatttgatatgatctctctaaaatagacaacttaaataaagttgtccatgaaaagagggatcttttcttatggcacgtaatatacaataaaaaaagatacaagcagttttagagtataagaacagaattaaagaaataaaacaaataataattcaagagcatttaaatagtaaagattctttgagagatttaagcaataaatacaatactcattcttcttcatctttatgaagttgggctaccagttataatagtcactaaaaattaacagattatgatcctaaaggagatgtctacatgaccaaatcaaaaaaagcaacattagaagaaataattaaaattgtataatattatttagattatgagaaagaatataaatcagcagctgaactttttgaggtttcttactcacaagtatatcaatgggtaaagaaatatttagaattaggtgaagaaggtctaaaagacagtagaggtaagcgcaaagaggaatcacaattaaatgagttagaaaaattacaatatgaaaacgaacgtttaaaacaccaatctgaacttaaagaaaaaaatattatcttaaaaaagttgaaggaagctaatattactcaaagtatgtcaagagttggaaaatgtatcgataacggttctgctaaaagattttggagaattattaaaagtgagatgtattatcttaacaaatttaattctttcaatgaattaaaaaaagcaattgaaactcatattgacttctacaataacgaaagatttaataataaggtaccaatgaaagtacgtttagaagctctaaatggtactgaaaatccagcacaatatcctaccaataattcattaaattacgcaatggtataataaaagatgctttaccaaatggaaaagcatcttttattttgttatttcttatttcttgttggtttgtacatcccacccggtgaataattatctgcatattttttagatacttttttcactaatgaaactacttttttctttatagccatgttttttcacctccatacttacacctgtaaaaaataaagtaaaaccaattatcatgcttagtcgtggttctataggataaattaatccaatcacagccagacatccccaaaaaattaatttacttattttcacattccgtgcttcatgattttcttgccacataaatgctttagcagcaataagtattgccataattagaagatagctattttcaaaatccgcaaaatagagcgtaccaagatataacaaagtcgttaaaaacatacagcgataaaaactatcagcatgataaccgtctacaaatgtccgtaatccaactaatgcaataataaatattattgtttctagtaccatatttctaaaaatgccgattgctaacaacaaaaaaaataaaatcatttgagtcaaaatgagttcaataccaaatcttacttcatcaatttcatcctcagtcacattatcaacatctaataaaaatatgcttattttttcacaaaaacgtttcatatctatcctccatgtccattatactattaaatcttcctaaaaatattttcaatgtactaaccggtcctattttgttattaaatacttctaaaaaaattaaaactttgtgccggacaatagcacaaagctttaaaaaaagagattagattattaattcaaacttctatccaatagacgtttgtgagaaatagctataaatattacttgcggccatgtagtaatattataacttggagattatgtatagaaagacaatactttttattttattattattacatctctcccataatctattatactacacaacttaacagcttgcggttttatcctttttttctacactaacggtcaatattatgacataaacggctttttaattatcaacattcagtaaaatatcgcaatgcaccttgttattttcatagaaatattccattgttccatgataggtttctacaacctctttaatgattattaatccttttccatgatctcttccttttttactttcataattaagaggtctattagtcgaatttattatgctgatcaaaagcatattgcctttactaaaaattttgatttcaactatcttctccgctgtttttaaagcagcttcagtagcattatctatcagattaaataatagagaacataatttgtcttgagcaatattaacattgcgatcaatcactgcatctacaacataattaacttcatcgttattgcgaatcttcgcatttaaacaagcatctacaaaaatatttcccgtacgtatcaatttaactggagcatttaaatcttctttaattgcttttaaatattggttagcgactgattctgtttcgactacttcttctaggacttgtaaatgattattaatgtcatgcttaaacttataaagacgttcttgttctttttctaattcactaatatgacggcgagttgtagcatatgaataatttgctaactctaactccttattacgtaaatacatacgggaagaattgatgatataattatttaccaaaatcatttgaacacctgctaagatcaatataaaaaagatataaatatccccctgttcaactgataatacgtttaaaatcagtacaataatcacttcaacaatattgatcaaacaaaacgaatataaaaattttttaggtaactgatgttccacaaaatcacgtttttgaaccgcatatttgcatatcaatgctgatgatatatagtttcctaaaggaaaaacaactcgcatactcccccatacgatatccaaatatgtattgtcaaaaatttctagcgccactgcaatcataactgagccgacaataatttgaattgaataataaattgtagtgataaacaaattattaagcctaaatctcttaaccaataccccacaataaataaaatccaaactaatacacattaaattaccaattacatataaccagccattatgtggtgaagtatacgtaacaatattcaaaacaaacgtataacttaatataaccataatatttctaagcatgttttctttacgaatatatggataggttaatgaaataacataacttaaagcaacaacatatatcaatgtatataaatactcaataaaaaaattaatcatcactctttgatctcctgcattaaaagattaaatacatctttttttcttcttctactaatttctagcgattcatcaataccttttaattttaaaatatatccattcatcgaaacaaccatattaatattgattatctgacttttatttatttggacaaaattatctggtaaatactgattaacttcttcaagcgtcatataaggaatatagaaattattatcattagtataaaaatgtaagtatctttttactgattcgatataaataatatttctacttcgaaaatgaaaaatctctccctttttcttgatccagatatcatcattttgttgtctacgatttatcgctttaagcaaggttggcgttaactttgtttctaattctgatttaagtaaatatcctgctatattaatatcaaacgcctcctgcattttattttcataattagttatatatattatgatcgtattttgtttcaataatttttttgctacctgtattccactcattgttggcatatcgatatctaataaaagaatatcaaagtttttaccacaattaaaaaactcttcaacatcttgaaaaagttcaactgtatatggttccttaattctagcctcctctacataccctctgattctaagtagcattgaccgctcatcatctagtatacctattttcatctttacacctcatttatttattatacttgataaaaccttttttgactaattaaaaaaggcccttaggccttatcctgttgctttttttcatagtaatttcttaccagcacttgtgttttacgaatatgattttgaattttttctttagctaaatccttatcacgagctaaaattgcctcataaatttctcgatgctcctgtgctgctgaaattaaacgatccggttgacgaattgaatgccttgaagttacatgaatataataattaatatctgttaataattgctcaaaatactttgattgggtacaacgataaatagcctcatgaaaagcaatattaatttcattaaacttctcttgatcacctttttcagcataaaattccattaaatcatacacttcttttatcttttcaagttcctcatcattaattcgctcaattgctaattggattgctagcccttctaaagcataacgaatttccaacatatcatcgatatcacgatgagaaaaccctagtacataaactcctttattaggaatacttttaaccaaaccttctaattccaactgttttagagcctcacgaattggagttctagaaatattcaactctttagacaaagcaacttcatttaatttttgtccttgagtatattcctcatttaagattttatcacgcaaaacggtgaaaattttatttccaagcgacccatgtccggtattttctaataaattctttgtcattgtttaacctaactttctgatgatggctgcggtgaactcgtctgttgaagcactacccccaatatcaggtgttacagtagttccttcttcaactacagctgctaaagcctcacgcaatttattagcatcatctaatttccctaatgcctctaacattaatgcaaatgctaataataatgcactcggattagcgatacccttaccagcaatatctggtgcacttccatgaacagcttcataaattctaaattcatcaccaatattcccacttggtgcaaatcctagaccgccaactaatccagcacataaatcagaaacaatatcaccatataaatttggtgcaactaaaacatcaaaagtttctggacgaattactaattgcatacacatgttatcaacaataacctcttgtggctcaatatctggataatctttagccacatctctaaacgcttctaaaaataatccatctgtatatttcataatattcgctttatgaactgctgtcacttttttacgtctattgttcttagcatattcaaaagcataacgacaaatcttttcactcgcttcacgagtaattaatttaattccatttgccatatttggattgatcatatactcaatccctttatataaatcttcggtattttcacgaatcataaccagatcaatgtcttcataacgagaattgattcctttaaatgatttgattggacgaacattagcataagttgcaaactgttgtcgcaaggcaacattgacacttctaaatcccgttccaatcggcgttgctgtcggaccttttaaagcccatttatattctttaatagcatcaacaagtcctggttcaaaaacttctttcgttgtagctgcatattcagcaccagcctgatattccacccattcaatgtcaagcttcatcgctttagtgatatcaacgacactctttgatatttcttttccaattccatcaccagggattaaaacagctttcattaaaattcacctcccaattctttaattgcatttaataaaccaccgtaattaatcattactttttcacgaggtgataatgttaattcagcctcgattgaatcattagtagtttcattaattacttttactttaccattatgttcaacaacatctttgatattaacgattttataactatcttggtcattgaagaaatcttggtctttagcttcaataactaaaggtaaaataccattattaattaaattagaacgatgaattctcgcaaatgatactgcaaagattgctttaatctttaaatagtttggtactaaagccgcatgttcgcgggaacttccttgaccataattatcaccaccaacgatgaatcccccattattagcaattgcacgatcatagaattcaggatctactttactgaatgaaaattttgctaaatgtggcacatttgaacgatatggcaataatttgctatctgaaggaacaatatgatctgtcgaaatattatcaccaacttttaaaacaacttttccactaatttcatctgtaattttttctccacgtggaaccggtttaatattaggtcccatatatacttcattattttcgtcatattcatcaatgaagaaatttccatttttaataaatggagtatttggcacctcttctaaatacatatcatcttcaaattcttctgacatgtaccctttaattgcgctcaatgccgcaatttccggtgatactaagtatacgcttgcatcatttgttcctgaacgtcccttgaaattacgattaatcgttcttaatgaaatcccttttgagagcggtgcttgacccattccaatacatggtccacaaccacattcaagaatccttgctccagcttgaaccatatcagctaatgctccattttgtgaaagcatcgcaagaattgaacttgatcctggcgcaataactaaagaaacatgatccgcaactttgcgtccttttaaaatcttagctgccttcatcatgtcagcaaaagatgagttagtacaacttcctatcacaacttgatttactttcattccttcaagttcttttactggtactaccgcatctggactatgaggcttagcagtcattggcactaatgcacttaaatcaacatctaattcttgatcatatgtagcatcttcatcagctttcatttcaatgtaatcatctactcgcccttgttgtgctaaatattcttttgttctttcatcggtcgggaaaactgatgtagtggctcccaattcagcccccatattacaaatcgtagcacgatcagtcaatgataatgaagcaactccatctcccgtatattcaataatcttattaacgccacccttaaccgttaattgctgaagaatatataaaataatgtcttttgcacttacccatggtgctttttttccagtcaaattaactttaacaacactaggacattgtaagtaatatttacctgttgccatcgctactgcgacatctaatccccctgccccaatagcaatcatacccattgctccacaagttggtgtatgtgaatctgatccaactagagtctttcctggttttgagaagttttctaattgtaattgatgacaaactccattacctggttttgaaaaaacaatcccatgctttttagccacactgcggataaattcatgatcatccatattttcaaatcctgtttgtaacatgttgtgatcaatatatgccactgctttctctactgcaacatgtttaatattcattgcttctagttgaagataagccattgtccctgttgaatcttgtgttagtgtttgatcaatttgaattccaatttgttctcctggaacaagatttccatctttaagtttactacttaaaattttgtatgctaaattcatacccatcacgatatacccccattattcttatattgcatacaattatacaaaaaaacaatcttgattacaaccctttggaacaaattttaccacaagatgtactaaaaataaaacactttaataaaaatctattatttacttgatttaatcgagtaatttttaattacacttttttaataataaatttgtgaattcctaaaataaaatatctacttttcttcttaaaacaaaagccttactataaatatcaatgaaaatatgttagaatacattgggtgataaaatatgttaatagaatgttcaaatataacaaaatcatttcaagggattcccttattaaaagatataacctttaaaattgatgatcatgataaagtcgcaattatcggagttaatggtgctggtaaaactactattctaaaaattattgcgggcgaagaaaactatgatagcggtgaccttttttgtaataaagaattaacactaggttatttaaaacaacagcatgacttagcgatggataaaacagtttacgatgttggccttgatgtttttgcaccattgatcacaattgaaaatcgactacgtcaattagagaatgaaatgacaactgatcatagtgaacgtattttaaatgaatatgatcgtctaactcaatcatttcatgataaagatggatatagttatcccagtaaattaaccggcgttttaaagggactgggctttagcgaagaagaattcaatttaaaagtttcaatgctatctggtggtcaaaaaacacgtttagctcttgctaaaatgctgcttcaagaaccaaagctattgttacttgacgaacctactaaccatttagataatagtgctattaatttcttagaaggatatttaaaaaattatcctcatgcaatcatcacagtcagccatgatcgttactttattgatcaagtttctaataaaattgtagaagtcgaaaatggaaaatccaaaagctataaatgtaaatataacgaatattcaattttaaagaaaaagcaaagagctgttgatttaaaacattatttaaatcaacaaaaagaaattaaaagaattcaagagagtatcgatacactaaaatcatataaccgtgaaaaacaagttaaacgagccgaatctaaagaaaagcagttagctaaaattgaacgtattgacaagcctgagaacttgccagatacaatcacgattaattttaaaccaaaacgtgagtccggttttgatgttttaaaaatagagaacctagctgttaaatttgatgaaattttatttaaaaacattgatatcgatataaaaaaacaagagcgtattgctcttgtcggggataacggtgtgggtaaaacaactctttttaaaactatcctcgatcagctaaatgcttatcaaggtaaaattaaatttggtagtaaagtagaccttgcttactatgatcaagaacatagcacactagcaatggataaaactatttttaatgaaattagtgataattttcctaagatgactaatactgagattcgcaacagtcttgccttatttaacttcaaaggcgatgatgtttttaaagaaatctctttactttctggtggtgaaaaaggacgtgttgtacttactgaaatattattaaaacaagcaaatcttttaattttagacgaaccaaccaaccacttagacattgcttctaaagaagttcttgaagatgccttaaaccaatttgaaggaacaatcttctttattagccatgaccgctatttcattaataaagtagcaactcgtgtgatcgaattaacgagcacaaaagccatcagttacgatggtaattacgatacttatttaaatcataaaagcgttgctaagccgctcaaaaaagaaaatgttgattatcttgatatgaaacagcaaaatgctctttatcgtaaacagcaaaataaaataaaaaagatagaaactaatatttctatactagaaaccaagatcaacactttaactgaacagcttcatagtgaagaagttctaaatgattatcagaaatataatcagatcaatgatgaaatttccgaattagaaaatcagttaaatactttaatggaagaatgggaagccctgcaataagggctttttatattcttttaactccaagaatacaataattttcatctacacctgagccttcacaatcaacatactcaacttttactacacaactgatatttgtttttcctagttttcgtaaagaaacacaatccccctgctcaattccctcttctttacaaacaactaaatggttaatcacaccgttacagattttatcaaaatattggctgtcaacctgtaaactacacatactaaaactcctttcaaatctttaaatattgtttatagtgatcagatccatcaatttcttcaattcgtatctcaatcgttttttctaaatcctctacaattgttttttcattaaccagatttttttgactaatccaagactgatatagtggatgaattataaatcttaatgttaaagcaattgataacaatccgaaatctattgatacacctaatattaatggtttaagtaacattcaaccatacctcctagtattgccattcactcatgctttgatactatctaaatcacaataactaacacatatatatgctctaaataatttattatgtcagttaaataaaacattactactatacttaaccatatattgcattacttttttgtctaatctagtggaaataaaaatactttaattcttcaatccaaatatttaaataaaaaaagagcaaaataattaaatatcctgctcttttctattaaccgtttagtaattttatttaatcgatttctttaccagatccagctctttgctaatttccaataattccttaattgcaatttctagattttgtcttgggtgctcttctaaggacttcttagtcgtactaattctctcggctatgttttctaaactttccatgttaattctccctttttctttattctaccattttactatactctatcatgccatatttttgcagaccatatcagactatgataaattaaaaaaatgtccaatttaagctacattaatttaaattaataataactttcttgctctccatgataatatacttttgataaagaaatatacaaaaatctcttacgattacaattataacaaattcatcacattagtccaagataaaaaaatttttctctagtttataaaataaagcaattattagaataaaatgcatatttttcatttttaaaggttatatttagctaatatgtattacccttacacttagtaaatctttgattttaccatccctctttagtgcttttttcatattttggaaaacggttccatttacattactttaaggtataataaagccgtaaaaacaaggaggaaataaaatgttacacaaaaaactaaaaccattcccaagtgattttttatggggagcttcaacatctgcttatcaagtagaaggagctaacttaatcgatggaaaaggaccatcttgtcaggatgtcaaaaaagtacctgaaggaacttcagaacttgatgtgtgtgctgatcaatatcatcgttataaagaagatattgcattgatggcagaaatgggattcaagacttatcgtttctctatcgcttggacaagaattttacctaatggaactggtgaagtcaatccaaaaggaattgaatattataataatgttattaatgaatgtttaaaatacggtattgaaccattggtaacaatgttccattttgatatgccggctgctttagatgaaagaggaagctggggtaatccagaatcggttgactggtttgtaaactttgcaaaagttatgtatgaaaattatggtgatcgtgttaaatattggctaacgatcaacgaacaaaatatgctgactttagttggaccggtaattggtacattacacttgccggaaggatgcacaaacgaaatcaaagaaatctatcagcaaaaccatcatatgctggtagcacaagctaaagcaatggcattatgccacgaaatgattcctggagcaaaaatcggacctgcaccaaatatttcattagtttatcctgcttcttgtaaacctgaagatgttctagcagcacaaaactataatgctataagaaactggttatatttggatatggcggtttacggtgtatataataatttagtttgggcttacttagaagaacatgatgcctgcccaacatttgcacctggagatgctgaagcattgaaaaatggacatcctgattttattggtttcaactattacaatactgctacttgtgaagctagtgatggaactgaaacaatggatcctggagctgatcagcaaactgctcgtggtgaagccggattctatcgtggatttaaaaatcctaatttaccaactactgaatttggatgggaaattgatccaatgggattccgggcaacaatccgtgaaatgtactcacgttatcgtctgccaatgatcgttactgaaaatggactaggagcatatgataaattaacagaagacggtaaagtacatgatcaatatcgaattgaatatttaagaaaacatcttgaacaggtacaattagcaatcacagacggttgtgaaatgatgggatactgtccatggtcagcagtagacttgatttcaacacatgaaggtatggtcaaacgttatggatttatttatgtagaccgtgaagaatttgatttaaaaactttagatcgttatcgtaaagattcattctattggtacaaaaaagttattgccactaatggtgatgatttatcagattaatttaatcttaaaaagtcttctatagaaatctatagaaggcttttttgctaataaatatagtattataacaacatgttttctatttaatttaagtaaatttgctaatctacaatcttttcaaataccgggtcataactaactaattaattattgtttcaccttcttgttgcaattattttaacgcttcaatcacaatttatctattattctgatcaactgcctaagcctgctcacccaccaagatttcttcctctgaacatttaatatccttatatccttgtagtgtttgtttatataaagccatttttatttttccttctcatttcctttttcatattctaaagctaattttaaatcatattccattattttattttctattaaggcaaaactttgaaaaagcaactaatcatttccacttttctagcgaatagcttaatttttttatcaaataaaataatattcccacttgttaatgaattcaatcattcctttaaaataggattcggatagatatatttaatgctgataatacagcaataaaaaaacaatccctctttatctatatctgaataatgagataaaaagcaagaaaaataacttttatttaatgaagacatcatgtttttaatactaaaattattattcctatataataataaaagaatcggctgtaaccaattcttttattctacatcttcttcatatttaataatttcaccagtatctgcattaatttctaattcatattccttattaccatttttaatctctatctcatattttttaattccatcatcgtcatcataatctaactctgtttttattaagtaaccaccaccaacacgatcaaaagcgattttttgagcttcctctaaagaaacagccgtattaacaggagtaatcggagtaactgttccatcaactggattggttgtcgtacctatataatcatcatctttttcccgttttaatacctttccactatttgcgtctacttctatttcatacttttctgtatcagttataatagtaaaatcatagtaagttaccccatcatctttatcttctttagccttaaggatttttccttctacttcttttaaagcaatttcttgagcttcttccaatgttagggcactaactttttcagtacatccaactaaagctattgtaattaatacaaataaaattattttcttcataaatattatctcctttcaaaatcaattgtaaaaattgtatattgatcaactatactttcaaccgtaattgcatagtcataatagctgcaaattcttttagcaattgctaaacctagtccaaaattgttattattttgagcccgtgactcatcagcccgataaaagcgattaaatatatagtctaatttatctgcttctatcccaatcccgtgatctttaaccattaatttttggtcaacatataataattcaattttcttttcttcttctcttgaatatttaattgcattatcaattaaaataattaaaagttgttttaaatgttctatgcgcatccatatctttgaagttacagttattttaataataaattcaaattctgggtgaacttctttaaaatttgtaattacttcatcaactactaaattaagatcagttggttcttcacaatgaatatccatttctcgggttaaatgaagaagttcattacacaattggattaatcgctcaacttcattactagtgacattaagtgaattgctaagaatagcaggatcatcttttccccaccgctccaacatatctaaatttccttttataattgccaatggcgtttttaattcatgtgatgcatcacttacaaattgattttgttgtaataatgatctttccgcttgatcgattgtttcattaaattccttgcctaataaagctaattcatcatttccctcaataacaagccggtgacttaagccctcatttttaatttgtttaatactctttgtaaattgatcaacagtttgtaaaaaacgtttactaatcatgaaaccacaggcaatactggtaatcaatgcaacaataattaaaatcaaaaagattacagcaacaatactagctatgggggttatcaaatcttcatccattgcatagattcgtccaataatcaataaataataacccatataaagtaataaaatcaagctaaatactacgatcactgtcataataataattgaagtagtactaactaattgatgtcgtagtgatttaattttcatgataaacggtatcctactccacgtactgtttcaattttaattccgggaattttattacgtaaataacggatatatacttcaacgacatttgttgatacatcttcatcataaccccaaacctgatctaaaatcttattgcgactaacaacatcaccgccattttgaactaataatgataataaatcaaactcagtcgttgttaaatttacttcattatctttgaaaaagaccttgtgcttacttggatcaattttaacttctccataactatattcaagaagtgctttttgaaagttcattcttctcaatagtgcatttatcctcgctaataattcttccattgcaaacggctttgctaaataatcatctgctccaacttgtaaaccattgaccttatccatcacctcatcacgagctgtaagcataattactggcgtttgtttaatctctcgcaagcgtcgacatacttcgattccattaattcgcggtaacattaaatctaataagattaattcatattcttgctctaaagctttttttaacccaacttcaccatcataagcttgatcacaacaataacctgcatgggttaattctagctttaatagatctgacatatttttttcatcttcaattatcagtattgccatcttcatcactccttatattcaaatccaattatctttccactttttgcactaatatttatctcaatcagttcttgctgctgattctctatttcaagatgataaaatatttgcatatgctcatattcaatttgtgaagatacgatagttcctggaaattgtttcaatgctacaacatgtgcttcacttttagaataattaatgttatttaaagttgtatgtaatatatagacaccaaaacaaataacactaatgacgattattattgtagttgttataatttgttttttataaataatcagcttttccattcccatcttcctttcatctatatcataacctattttgcccgattgttgcttaaagaacaataataattaaataagaattttctcattttctaaaaataaataaatgtgatctaaaatcacacttactcaaataaagcaaattctaaataataaactagatcatgaaacattctagtattaaagccataacagctgcaatcatctatttctccatcccaatcattatttaatcgttctaataacagcggtacctctgtaacatctaaattagctgttacaaaaaactcactacaatctttttttccagcatactcacgactcggtgaaattgaaaaattaggatttatttgtaacaacaaatctttaatcatttgataatcttttatatcttcactttcaataattacatataatctcgctaacataaaaccacctctttcctgcctattttatcataaaatattgtttagataaaagtatgctattaattaattttattctgattatatttactaataaatatgttaagataaagtaaagagatatatttgaaagctgggataattatggatgaatcactaattacgatcattgggtttattattggaggcctatctatctttatttatggaatcaatcttatgagcgatggcctcaaaagtattgcaggatatcatatccgtgagtatattgaaaaatatacaagtaatctttttacctcaattttagtgggtactttaatttctgcaatcctccattctagttctgctgttacagttatttcaatcagtctggttcgggccggattaatgaagttggaacaggctataggaatcacgattggagcgaatattgggacttgtgtgacttcaataatgataggcttgaatgtggaacaatttgcttactatcttgtctttattggggttgtaatcatgtttttagctaaaaaaaagacgattggatacatcggcaaagttgttctgggctttggactaatttttgttggtctacaaataatgagtgatcaaatgatagcctttgctaaagaaccttggtttacaagtatcatgacaacgttaggaaaaaaaccatggtgggcacttctaggtggaactatagcaacaggcatcatgcaatcatctactgctgttatcggtgtagtccaaaaactttttacaactggttcaatcactcctgctgctggtgctgcatttatttttggggccaacattggtacttgtattactgcggttattgccgctttaggcggatctatttcaactaaacgagctgcctggtttcatgttgtttataatctagcaggtgcaataataggaatgctcgttttaaaaccattcgttaatttaactaattgggtcaatttgctgctaaacggcagtcaagaaatgtatattgctcaagcacacttcatttttaatatagcttcaactattttagttattccttttgttcgctattgtgttattttattagaaaagttaattcctgggaatgatcatcatgatacgctcattgaaaatatcgatgagctagatgatactttaattgacaaacttcctgtcggagcattagcagttgctaaaaagaatacactccgaatgggacgaaatgttatagccaatattaaattatcttatacttatttaatctctaaaaatagtgaagattatgatgaaattatcgaaattgaagcactaatagataaatatgattctcgtttatccaaatacttgttaaaaattgctcaacagcccacattagcaaaaaagcaaactaatgaatactttaaaaattatcaaattatcaaaaatcttgaacgaattggtgacattgttagtaatttagctaattattacaaacttgtttacgatgaaaaaggtaaattttctaacgaagcaatcaatgatttaaataaaatgtataaattagctttagaaatggtccaagatgctctagatatttatgaacacgataatgcaaataaacttctttcttctttaaacaaaaaagaacatactttaaatgctttagaaattgagtgtcgtcaaaatcatctagtccgaatgcgtgacggtatttgcgaagataatatcgctgcttctatcatcattgatattatttctagtattgaacgaattggtgatattgctttaaatactgcaaattcaacaattacggtatacaaagatcataaagttaaatatttaaatgtttgatttttacataaaaaattactggaataacatccagtaattttaatttattgcatctttatcggtttcaccggttctaattcgcaaagcactttttagatcataactaattattttgccatctccaggattccccgtaaatgctgcggtttgaattgccttgattgtcttcttttcccaaacttcatcacttactataatttcaaatttaatttttggtaacatatttatttctacttcattacctctaattacttcacgatagcccttttgaattccacaccccataacttgataaactgtaatcccatgaacttcaattttagctaaagcttctttaacatcctcaaacttatcttcacgaacaaatgcttctattttaatcacaaatcactcctccttactctaatccattaaatgatgggtatgctgtctcattatgttcagacatatctaaccccatctgttcatcacgtttatcaactcgtaatggtgtaaatagccgtacaactcctatacaaattaaagtacctatcacagcaactactattgttagtaaaatgctaataatttgtgcaattaataagtttgtatctccgaagaataacccattccatctagctacatcattgattgaagtttgagcaaaaagccccgttgcaataccaccccagataccacctattccatgacatccaaatgcatctagagcatcatcatatccaaaatattgttttgctttagaaatcataaaatagcaaattgggctaccaacaaaaccaataataactgcagaccaaatcggaacaaatcctgcaccaggagtaattgctacaagcccgacaactaggccggttacacttcccactaaagttggtttattaattttccaaacatccatcaacatccatgataacattcctgaagcagcagcaacagcagttgtcataaaagcgtgtattgctaatccgtcagcttttaaagaacttccggcattaaaaccaaaccacccaaataatagaaggcttgcacctagtacaacaaacggaatattatgaatacgatatttcgcatgatcataatccttacgtttacccaagataatacacaatactagcgcgcttactccagaactaatatgaacaacatttccaccagcaaaatctactgaaccaatttcagccaagaatccccctaatccccagaccatgtgagccataggataatagacgattgttgaccagacaattataaaaataaacaacgctttaaacttcattcttcccgctacagcgccagtaattaaagctggtgtaataattgcaaacatcatttgaaatgctgcaaagcctaaatccggaatcgtactggcataattacctggcgtcgttcctacattactcaagcccaaaaagcttagatccccaattattcctagatgatcatttccaaacgccaaggaatatccaaataatatccacataaccattgctattccaattacaaaaattgaagtcatcatcgtattaaccacattttttcttctaaccattccgccatagaaaaaagctaatcctggtgtcatcaataacaccaatgctgtacagattatcataaatcctgtatctccagaatcaatcatatttcttccccctttatttatgattatattggaagtatagatgatatttttttattaagcaagatattttttatcactaattattttcagtttaccttgtcgtaaaaaaacattgatattatcatagttttttaatttgttaaaatattgttatttttatatatgataaaaatagttattggcatataagtttccaattaactcgttattgtatattagtgcagttattattaattcatttaagttagaaaactatagatcattacaagataaaattaaataattgtcatttttaaactgtttttccataaccaacatagaatgattcacaaaattatttttaaagtattcttttgaaattaaaatcactcctataaaagttatacctgtgactattaatcatatatataaatcatttggcacagctctaattagaactgctccaattacaaagtaaaacaatatatatataattagtatcttagataaaatacttaatccttttatctttttatttaaaataaactatataaaaatcatagcatatctattttataaaaaaggcataattttttcacaaaactaaaaagagctgtaacattctaaaatagtaaaaaaaactactcactagttacggctacttctataagtatatcttatttccaaattacactgctattatgtttatctccttctttacttggttctatagctatcaatctattaacttttttgcacaagtgggacatgcaacataaaagtaagtacatccgttttcacatttataatctattattttaaaactactaacttcagtatcaatgctctctttagttactatctttttcattattttcccgtcaaaagagatataaaacaaaaactatatcacttttttatgccttacgttaatattaatcaaaaaataattatacgatattttgttctattacattaataatattgtatctattttttatcgtagcaagataaattttgtagtatattcttgttttcgtaattttcctaaaataatatatttgctaattattcaagaacttttctatatcttcataattagatatttctatattaaaaacatatgaaaaaaatttttgcaattcacatatatcatattctttaaaatttattttatgtatcttttgatacacttcttttactaaaaatcttaaatctgaaatataattacaacatactaaatcaacaacatctttaaaaatatctctatgcataataacctatcccctcaagctttattcacaaacattttaaatataaatactgaattaaaaaatacatcaatcaaataaaccaaaataactctccaaaatttcaatacaatatacaagtaaatacctttttaatatcatattaaatttttaataatattttttcccaaaaatatatcctatatcaataaaatttgggaacaatttaatcacataattatcatattatatagttgtaaaaactataaatagcttaagttctgttgtaggtggtgaattatgcttgactattttttagaaaacactacaaaaaagaaattatatcttttttccatcttatatttaaagagagtcacttctgtaaaagaatgtaagtatatacttacatttagcagtaccagtataatttcaataattaacgagttgaattttgatttcaatggaattgcagaaataaatataacaaattcattggaacttaaattaattgtatacgaagatattacattttctgatttactccatgctatataccaaagctctaatgtattgcattgtatcaagtttatgataaccaatgaatcaaaccattcttttttggtatttgcggaagataactatcttgcaaaatccagtgcatatcgaatacgacaaaaatgtattaaatatatccgcagtatcggtttggatattaaaaaaaataaagttataggggaagaatacagaattcgatttttgattgctcttttatactacaaatgcggtatagattgttgcgatattgatgaatattcaataaaacttattaaagaatttattatatctactaaccagtcaattacttttgaatttcttaataacgctacaaatgaatatgattattttgaatgtctaatgtcacttttgtggaaaagaaaagaccgcaatgacaatttatctataccaaaggagcttgaaaaatttaaagagatttttatatacaaagatttgaaaaaatatttacataatgtaattgggaatcagcttaacatagatttttcaaaaaaagactatgattatatgtatttagtttatttttgtactaataactttctttttgccaaccagtggacagaggaacgtaaagagcacatttataaaatatttctttccaatcaaaaattttatgatttatatattcgtcttagtcataaatatggtaaatttctagaacaatctcacattttcaaaacaattttaatctatttttttaaggatcatctttttcaattacaatgcctaattccaaatcagcgtctatatatagatactacacctactacaacttacatcaccaataatgacgtatcaggtatcataaattcatggaaaaaggcaaataatatattatatccaacagataaaagaagtatattctatttaacaacacaaattgaatttatattaagacaacttgttccacctgtaacaatcatattgttatctgatttaatgtccgagatagaaatgataaatctttttcttgaaaaaaatttttcccgcaatcgaattaatataactccgttacttttaaacagttataatttagaatatctgaacgctgaaaaaaatagaataataatcattactcgaggaattgaatatttattaaaatcatacaatttctttcaaaataatactatagtaataatagattctagaacaaccttatacgagaaagaaaaaatttcgaatgctattgccaattatgaagaaaaacaatttctaaaaatttgtgctggaacaagtcttactgatacagaatattaatgatcaacataagtgcaacagtctatttatacaaatattatattatttaaatagcatattttatcttaaacttatttcttggcaaaaacacttaaatcaaaaaaggactgtaacgaataaaaattttaatctttgacatacccccttctaagtgacaattttttattatttcacttgtctacctagaaggaagcatatcatttaatccgttacagcccctttaatcatatactaattcatcttgatttataacctcttcatcagtaaaatatgcttgagtttgtactatgacctcttttcttaatccaattaaaccaattaaattagggatagccatacaaccattaacaatatctgcgagaataaaaataaattctaatgacataaaaggaccaattgcaataaagacaatataaataaatttataatatggaatcgcttttaaaccttttaaataatacatacatctctcaccataataattccaaccaattatagtagtaaatgcaaagaaaattaatccaatattaacaatatacttcccaatcataggaataaataaaccattactaaatgcttgtgtagtcattgcggcaccttctaaaccactagtatggctattagtaagtaaaattgcaattcctgtcatggtacaaataacaactgtatcaataaacgttccagtcattgataccaatccttgttctacacatgaatcagtttttgctgcagcagcggcaattggtgcacttccaagaccactttcatttgaaaaaattcctctactaattcctttttgcattgccattgtcatagtaatacctataccaccaccaagagctgcttgaggattaaatgcactatgaaccactaatacaactgtctgcgggattaagttaaaatgagtaattaaaataatcacaacaccaccgatgtaaagaatacacatcataggaattactttttctgctacattcgcaattcttttaatcccgccaattgtaataaaacctacagtgatcgttaataaaaccgctgtaacaattggtggaacattaaacgataactccattgcatcagaaattgatttaacttgagtaaatgttccaattcccaataacgccacagcaactccaaaaaaagcaaaaatcttagctaaccatttacttcctaaaccccgttctaaataatacattggtccccctgccatttgattattttcatctttgatacggtaacgaattgctaataagccttcagcatattttgtagccattccaaaaaaagctgatacccacatccaaaataatgctcctggtcctccggccgcaatcgcggtagctactccaacaatatttcctgtcccgatcgtagaagatagtgctgtacaaagagcctgaaaacttgatacatcaccttcatcattatcctgttttttaaaaatacatgaaaacgctaatttcaatttcgttaattgcaacagttttagcttgcatgtgaaataaattccagttcccaacaatagacaaataagcggtaagccccatacaagctcatcaatttttgtaagtaaatttgtaataaattgcataaaaaaactccttcttaaaataattaagtcggaattaataatgaaaaaaactattcatcccactgtccttttacctgagagtttcacctataaataggcttgctccttcggtgcttaatttaataagtctctccagaggttcgtccaatagcgatccttttacctgaaatctttaattcttcggtgttcaattagaatctctttcgccattatcatccgatatatacactaagattatacgctaattgtatacaattgcaaatattttttatttttgcaataaagtatttgtaaagacgacatttctcttctataataacaattatgaaaaaattaaaatattttattcctgccctaatttggatgatctttatttttataatgtcacacactaatggtaatgactcttcaaatcaaagtaatttcattgctgaaataattttaaaagttattaatattgatcgtgatacattaacttttataattagaaaagccgctcatatgagtgaatatgcaatcttattactcttactttattatgcactaagtaacgttatatctaagcatactttatcattatcattattagtcacatttatttatgcttgtagtgatgaatttcatcaattgtttattccagggcgcagtggacaatttaaagatgttctaattgacacttctggtgccttgatcatgcttatgatcatctttttatggcaaagaaaaaagaagtctaaactaatcaaataactttacttaagttattttgattaatcattagacttcttttcattttgcagtttttcaatactttcttttaacttatcaatggcatcattaagtacatcaagatcattttgatgatcatcgttgtcatcatcactcggtggcgttgagcgttcttctaagacagctgaccaagaagagtttgaggctaaaatatcacctacaacattaaaccatgctcccaaagcagcctgctcactcgtagtaaaatcatttgtcaatagatatcctaagatcactgcagttccagtaaaactatacggatcaagattgggtatatacatggttcacctctcccatattttaatatatgctaaataaaaaaaaaacttaggcttttgcatatttaatatttcgctgcacacactattattgggtgaaaaaatgaatgataatgtaaaattattaaactttatttatcaaaactcgcaaatgggagttgaaacgattgagcaattagaaaaaatcgttgaagataaagactttaaaagatatttaaaagaaaaatatgaaggctattgtaaaatccataaagatgctaaagaaaagttaaatagtcatggatatgacgaaagaggaattggttcttttgaaaaaattcgtacttacttaatgatcaatatgcaaacactgaccgataaatcaactagtcatattgcagaaatgatgatgattggaagtacgatgggaatcatcaatgcaattcgtaatatagctgattacaatcatgctaaaaaagatattattaagctcatggaaacattaaaagctttcgaagaaaaatcatatggagatttgcaaaaatttatttaaattgctgttaatgcagtgctctcctaagttcaactttgtgagggcactacatatgaggtatattatttctaattaaaaacagtattacaaataatactgtttactatcactaattataatcaattaaaccaaatttcttaaacactggtttttgcaatttcataaaaatccccatcattggaccaaataaaaacattccaataatagttccctctcgtactgctaaaggcacatcagtaataattacaattataattactaataaaattgaaactacgtcaaccccttgccgtaaaacatggaatttctttccagtaactccgctaacagccatacaagctccttccaaagcaaatgtaacaatatctagaaccattaccattcctactgcaaaagcactgacgatatatcccaaaattaataatccaacattcatccaatatgtattaatcgtaaaattactgtatacttcatacaacatgaagttaacaattagccctaataagatgcaaacaggaatttgtaatagctggatcggcttaaattttcttctaagtattgccacttgaacaaagatacataaaaaattacaaaacataccaattgttcctacctctatccctgtaactaaactccctgtctgtgccaaagcatcccatgcacctactccaatggccgctttcaaagttagagctgaactacatgcaacgaccacaacgccaaacaccaaaactattacccgcttaaacattttaattagtacctcgctttttttgtataggcattattatagcggtttcaataatctagtcaacctattttttaagcgttttcaaaaatagaaaaagggtaatctacccttttaaaataactctacttcttgtatgagtgcaattagctcgcttaagttattaattacataatcagcaccagcatctaaatatgcttctttaacccgttcaattgcacgattccgttctttaggtgttaaagcattaaattcttcttcgttcaatcccaaagttgaacttccctcaatgacaccaactacgattacccctgcattaacaccttcttgaatatcagaaattgtatcaccaactttgattacattttttacactgcttatatgcagttcaatcatatttttaaaaatcatataaggataagggcgtccaaagtgattagtagcatcaggtgagtaccagcaatcaggttgatacccctgctccttggcactttttaatactggctccatcatcatatctgtatatccagtagttgagccaatcttaattcccaattctcttagttttgccacagtttctaaaacatacggcttaacatctgtatgttttgtaatacctatcattaatgatgcctcaaataaatcataaattttatgtatatcctgttcattaaattcacgatcatatctagccttaaatgcttcattcaatactggcatttctaacattgttttaatatgatcaatcttcaacatccccattggttctctaatttggtcattagttggctctaatccataattattaaaagcatctttaaatgcttgaacaggagcaaaacaaccataatcaattgtagttcctgcccaatcgaaaattactgcttcaattctactcattatgctacctccgctaaaaaatctttaataattgaacataaatttaatatatctgcttcataaatttcaccaatattaccaattctgaatgtttgagcagtagttaactttcctggataaattgcataaccacgtgcttttatataatcatacatctcactaaaagcaaattcttttccttcaggataatagaaagtagtaataattggtccttgataagctaaatcaacatagcttttcattcccatttcagccattttttcaattagcaaacgattattatcataataacgtttacttcgagcagctattccaccttcttccaacatctcatctaacgcttttgaaaatgccagtacgacatgggttggtgaagtaaaacgccattttccatctttatccatcgtttcccattgatcatataaatccaatgataaacttcttgctttacctcgactagctagtaataaatttttattagcaatcacaaatgaaaaaccaggaactccttgaatacacttgtttgcgctacttataataaaatcaatccctaattttcctacctcaatatcaacaccaccaaaactactcatagcatcaacgataaatactttatttctttctttaactacttttgctacactctcaatatcatttaagatcccagatgttgtctcactatgaacgatagcaacatgagttatttctttttcttcatctaatttttcagcaacagctactgcactaggattttcattttcagcaaactcaattatctcatgattaattcttgcgtgctcacatatatctttcattctttttccataagcaccattagcgacaatcaacagtttttcattttcgccaattacacttgtaattactgactctactccaaaagtcccgcttccttgcatcagtactacagtatattgctcagctcttacatgagctaattctaataattgatccctaatttttaaagtaatttttttatagtcatcatcccatgtacaatgatcaaataacatttcttgctttactgttgctgttgttgttaacggccctggtgttaataatttataatctttcattttcttctcctacttacattcttctgataatttttgatgtttttctaataattcggcagtcaatttttcactaaaagtttttggatatgctgacttatttgcactatcactagtttctccttggtaaaggggattagggtaggtttctaacagctctttacgtccactttcaataatacattgtgccatcttcattgctaatttttgatgttcactaccatctttatttacgactgcaactgattcagtcaaactaaaatttccctctgttgggtcaacaaaatcgattggaagtccatcagctttatcacgtaccgcctgatgacgtagaccaaagccaatcgctacttctccagctcgaacttttttaattgggcctgatcctgaatcttcgatatgtgctccggcattatcataaattccttttaatacttcctttgctccatcttcgccatattcacttactaatgcctgaattaataaccatgctgttgatgaagatgctatatccgtaactgagatcatatctttgtattctggcttagctaaatcttttaaacaggttggtgtttcaagactatttgcttttaattcttcagtattaataataatagccccttcttgtgaagtaatcggtgtgtaataagatggatattcatctaatgcttgagtatcaaaatctaaatcaacaaacatctttttttgttcttgagcactatcaagataaaacgagctcattgttactagatctgcctcaatattagttccttcagccaataacttacctcctaattcagaggttccaaaagtctgaaataaatactgtccctcataaccatttttatctaatgcatttttcattgccgttacagcttcatcatcggcatttgaataaataacaacctgatcatttgatgaagaacatccagttaaaagtgaagcacaaagtaacgaactaactactaacccctttaataatttctttttcattttaatgttttcctttctcttctttgcttactaaagtaactaaatactcctttagctaataaattaattaataaaatcaagattgataaaacaaagatttcattaaatttagcaaaatgctgtaactctttgatctttgtcgtcatcaccatcgtccgcgccccagcaataaagataaccgcactaacagtgaccatagcattaataaaataataactaaatacttctaaaattgatgaaattgcattaggtgtaataactctaataaccgttttaaaccagctatcacccatcagtttcgcagttgtttcaaatgaaccattcatctttgtcaatgagtttttcatcattaaatatggcgatgaaaagaaatgaacgatattacacaaaataatgatgatataagtattttggagcactgtcccagagaacattaacaagtatgctatccctaataccataccaggaatagtattagtagctagagcaatactttcaattatctttttcaaaaatttatttaaagtgctccgggcactagccagcgctgctccatatacgacaagtgttcctagtaatgctgtaaagattgcagtgattaatgaattttttattacccctagcaatgttgcatcactaaaaacattaataacattttgaaaagtaaaactaattcgatatggccactctccaacaaacggcacaattataattactataaagacagcaataataattacattaatcgttatgctcaatgtcccccaaaaccaatcacgaaaacgattctgtttgatttcaatcgtagagattttattataacgaatattatatttttcaagccgatgcaataaaataatactgatgattgaaggaatcagcattgtcattgcaacaactgccccacctgcaaaatttggaatacttcccaacatcttattgtaaagtacactagcaacaacatcatactttccacccaccgatgcaggaatcccaaaatctgtaaaacttagaaagaatgactgaataaaggctgcaaccaaagttcctaataaaggtcgaatcaaagtaatcattaatgtcctaaattcactatctttcattaatttggaaacaataataaattttttatcaatgtaactaatagcgttattaattaacataaaagcaatcggaaaagtatatataacataccctagcatcaatcccttaaaaccatatatatcaaataattgaaaaccaaataactttgtccacaacccttgttttccaaacgaatagataattgcaaatccataagtaatggtcggcaacaacattggcagcatcgaaacattattaattatccttttcaaccctttaaatatattcgtataatttaaagtgtaagcaacaataaatgccagtattactgttactagagcactcactccagaaacaacaaaactattttttaaagcatgcataaatcctgttgtttgataagtttgtaaataattatttaacgttaaacctccattattatagaaggattgtattaacagtgacccaattggtaataacagaaatatcccaaaaacagcaataacaattatataaataaacttgatttctcgatttttattcatttctttataccaccggactaaacaaagtcataatatttcttctttttatttccagctgatttaaaatgaagtcttgaacaaaatcacaacttggatgattaataatttcctctggtttaccaaactgagatatttttccttcattaataatcaaaacttgatctgataatgttaatgcttcctctggatcatgagtaacaataatagtagttaaattgtactccttagcaataatcttaattcgctctttaatagattccttgattactccatccaaagcgcttaacggttcatctaaaagaagaatcttaggtttcattaccattgttcgagccaatgcaacccgttgtttttgtcctcctgataattgatcaatctttttatctaaatgcttctccaatcctaacaagtgtatcagctcatctacttcttctttagttgaaatatccggtttgttctttaaaccatacgttatattttcataggcatttaaattaggaaacaaagcataatcttgaaagacaatattaaagcctcttttttccattggaacataagttaaatcctcattttcaaaaataattcgtccactatcaacctcactaattcctaaaataagatttaataaagtagttttcccacttcctgaaggtcctaaaattgaaacaatttgccccttaggtatctccaaactaagattatttaaaatatttataccatcaaatgacttaacgatcctttctagttttaacattctttttcctcctcgaacaactgcattatagctaactaaataaatttctatctattcttttttctttaaaacttggttaagaaagcgttaataaaaagaggtggtagatgtagaaaaactacattcacagctcctctttttgatatccacgatgtttaattaatctactatagtgatctagttttttagtgtaattatcataatcactgataatcacacccatatagatcatatcgactaatgcaatttgagcagttcgtgaaaaaattgcatctccatacaaaaactgatcattacttgttgataaaacaatatcaccatatcgagttaacatggtattttcaaaattaacaatagcaatcgtttgagctccagcatctttagcaatcttcaagacttcgactgtatttttagaatttcctgaataagatattccaatcgctaaactatctcttgtcagattacttgcatcaatactttggagatagtaatcactatgacaagtaacactctttcctaaatatattaatttagtcattaaatcatgagctacacccattgaattctcaacagcatatattgaaatatgctgactttgattaattaaagctacggttttttgataattcactaaagaaagagattttaatgcattttccagcatcgatgttgctgtagctacaattttacctggaagatccataattttatcatcggtgtttattgaaaaaccatataaaatatctatattattttctttatcataatttttagctaactctaatttaaattgtttgaaactgtcatagcctatcgctttaacaaaacgcattacagttggctgcgatacagcaacttctttggccaataacgtcattgataaatcttctagctttccacaataatttaatatataatcagctacctttttttctgatggacgtaaaatattgtatattgtttttatcctaaaattcactttgcttagcatattctctcctgtagtatttctactttattttctctttttatttatttttagtataagcaatattaaaaaaagctactatcatgctagctttttttatctaaagaaaaagtaatttttttgttaagaaaagaaaaaaccagatttttatctggtttttagattactaaggaataattattcctcgcgggttatcaagattatattctttagcgagcttaggaaaatgattatcaaggtatttttctaatgctgtatcatccaaacctttagtaagaatgtcttttatttttaagggatcattaattgtaattcctttacttgataatatctctatgatagaaacaatattttttaaactataagcctcaatcattattttttcatcatctaaaatgatatctagatccacataataattaagatgttgtccgactgctaaggtactaccataagtccaccttttaattattaatttttcaagattagactccacaattcctggattatataagcgtgaacacatcgatacgttaatctctttgatttcatcgaatgtaatctttctaattttattatcaagtcttaagattaattcttccccaatcaaaagatactcctcttgttgatcacctagctggtcaacatacacatttaatcgaacacgttcactttcctcataattaataactcgactaattttgttcagaacatcgtgtttcattattatcccccctttacacttttattaaacactatggtctaaaacaatagtcaagaaattctattcaaatatttattaattcaataaatactaattttataaaacgctatttagtatcgaatatatatactccatagattcttttaattaatgttttcttttcatcgaaactagaattgctagactaggtactaagaccaatctatatataataatatcatcacctgtagcaattaatcttttgatcgttgaaatagcatttttagcaggatctatcgtttttagcataagtaaaccaaattgggaaagctttaatactttcaatctgttcatcagtaattacactatcttcatacacttcgcaaattgggaaagctatggcaaaataatctgggtgttttaaaatcatttccattgtcatataattaccatttgaacagcctcaaataataattcactaacatgctccaaatgactcatcagcataaatagaattaccaacttgataattattattgcctccatcctcattgttgaactttgtagcactaaaatatattatatagataaaaaaatcctttgagatataaatcccaaaggaaatattattaaattccaaataataaatctaaatatgttggcattggccaatattcagcatcaatagattcttcaagctgatcaactgtttctctcaatgcttgcatcattgcaaaaacatcatcgcgccatgcaactgcctgttcaaaaatttcttcttcagaagcttgagctgcagcaatattagtttctaaagttgtcatttgttctttcattgtcttcactaatttagctaaagcattagcatcatcaactaagaaatcaacatctaaacctgcttccttagcagcaatcacttcagaagatacttttgataaataatcacaaactgctggataaatttgagatttggccatttttaacgctgttaacccctcaacctgaatagttttaatatagttttctagtaatatctcataacgagatcctaattcaactctactataaacccctaaacgatctaacatctctaaattcttttcttctttcaaacattttaaagcatcaacagtatttttattattaggaagtccacgttttgctgcttcttcttcccattctgctgaatatccatcgccattaaaaataattcgtttatgagctaaaacaaattctttaactacatcttcaaatgatttgcctgattcaatttcatcagccattttttccattgcgtcagctaaaattgcatttaaaatagtatttggtccagcaacagattggcttgaaccaactgctctaaattcaaacttatttccagtaaacgcaaatggtgatgtacgattacggtctgtattgtcttttgagaaagttggtactactgatactccagtggcaaaacgtgccgcatcagatttgctagttttcttaccttcacaaatttctgctaaaagagcatctaactcttcccctaagaacatagaaataattgcaggtggtgcttcatttgctcctaaacggtgatcgtttccagcactggcaatactcatccgtaataaatcagcataatcatcaacagctttaatcgtacatgcaagcgttgcaataaatggtttattttcagcaggattagcacctggattgaataaattaatacctgtattagtaatgactgaccagttatcatgtttaccagaaccatttaccccagcaaatggcttttcatgtaataagcagcgtaaaccatgctttttagcaatatcttgcataatttgcattaataaatggttattatcagtagtaatatttacttttgaatatacgcatgctacttcatgttgtgccggtgcaacttcattatgttttgtttttgaaggaattccatatttccataattcatgatctaaatctttcataaaggcagacactttacgtttaagactaccaaagtaatgatcttctaattcttgtcctttcggcgccattgccccaaatagagtacgtccagttaactttaaatccattctttcttggtaatatttatcatcaactaagaaatattcttgttcagccccaacagatgcagtaactttagtaattcctttttcaccaagcaaaggcaataatcgacatgcagctttagataatgcatcacaagatcgtaacaacggtgtctttttatctaatgcttctccagtatatgaacaaaacaaagttggaatatataaagatccatctttaacaaatgccggtgatgtacaatcccatgcagtatagcctctcgcttcaaatgttgcccgtaatcctccagacgggaaagacgatgcatcaggttcaccttttcttaatgtttttccactaaattctaatactgctttacaaccgtcaggttccaaaaaagcatcatgtttttcagctgtcaaaccagtcattggcataaaccaatgggtaaaatgtgttgcaccattttctaatgcccagattttcattgcattagcaattactgttgcgcattctttagataattcttcaccattatctaaagactcatggaatgccttgtaaatagatttaggaatccgttctttcattacatcatcactaaatgccaagcatccgtaatcttctaataacttattcatttccattctaagttcccccttgttagtttctaaacaacacataaccatacacttaatatatgtttatatgccgttattatacagttactttatttaggtgtcaatatctatatgatatttttttatcattttgttaattctttattaaaatgataaattatttataactgtttacttaaagatacttattacaactaagtaatattccatttttacaaaagaaaaagatgcttattcagcatccatatttgcttttttagcttcttctttcaaagctcttttgcgtttcttttcatatgatctatgagtagctgcatattcagtacattgcacatgaattcttttattagcagctacaaccgcttcaataaatcccattctatcttttggtgttacaacaaatctttttttattttcagcataaatttctaatgcccgtggactagttataagttttgtcatctttggtacaggatcacaaattgtttcacatgtcataatattaatttctttatctttaccaacacggcgattaattatcaatgttctacgattaattgtatatttatatggtcgccataaagaaaaatatgcaataattaataatccacaaatagcacacactatcgcaggtaccatttgtccaattataaataaataaactacatataccatataaaagatttcaaagtatagtattgcgggattcaatttaattttaaactctttttctttcataataacctctctttttcctcaacttcatcattataacgtatcttaaatactataacaattataaattatcaatcattgataacttatagttactatattattaaataaagaaagacgggaaacccgtctttcgattatcaaacaagtttgttgaattattctgcagcttctgcagcttgtttgttttgatatctttcataagcaattaagaatggtacgtatactaagatagatactacgattgcaattgcttgagatacagcacccatgatattagctcctgtagttaagaaaccatgtaagataggtggtgttgtccaaggtgtattgattacagcttttggacagaatccaattacagttaagatataacctactgctaaagtagcaattggtgctaatacaaatggaatacctaagattgggtttaataccattgggataccaaatgtaactgtttcattgatgttgaataaacctggtactaatgagatacctgcgattgtacggttatcttcacgttttgagaaaatcatgattgcgattactaaaccgattgtaaccccagaaccaccaaattcaccgaacatttgtaaccatgccattgcgaaaatgtgtaattcatcgctttttgcatcatttgttttagagaatgtttcgatattttctaacattaatggtgtaaataatgcttcttttactgcagataacatgttgttaccatgaatacctactaaccagaataacatgataatgatgtaaatgataattacaccaggaactgtagcaccgatagcacctaaaggtccttggatataagttgaaattacgtcatttaaatataatccagtagctaattcacatccacgtccaattaacgcaatgattgctaaagtaattacagctggaattaaaacttcgaatgcacgagcaacacctggaggtactgtttcaggcatttttaattttaatccttctactttacgtaatgcacagaagatttctactgaaacaaccccaacgatcatccctgtaaataaacctgttgctcctaaagcaccaccagcaacacctgtaaatgtttgtaatgctccatcagctgttaatgataaagtttgtttagcagtatctactaatgcatagttagcccatccactttgagttactgataaccaacaagcaagtcctaataaacctgcgaagtatccagtttcaccatttgattccccgatttcttgagcgataccaaaagtgattccaactgtgatacaagaaattgttgcgaattgcattgctgcaaacgctgggttaattacttctaaagccatgataggttcccagaacatacctaaccctgaatctgcattaactaatacgttacaccataaaaccccgatcgcacctgcgatagtcaaaggcatgaatgtttggaacgcatttttaattgcagataaatacttgttttgcccacaccacgcaccaacgcggccaaggacatctgccattttgtccatatttttttcctcccttaaaatatctattgacactattagtataaaatttaaactggtaaaagtcaatgctttttactttcaaaagtaccatacttttaaaaataaaaccggtattgtcctaaaaaacgttggtatatagccatttttcactaaaccgcttacaaaaaatttttttataattttttacaaaaaaataaaaacgcttacaaaaataagcgctttacattgctacagtaacagtttggagctcaaaatcattgtaatggaaacgtgaaaatgagtattcaaagatcacaccactactcaaataagctacttgttcaacttcaaaatatggctctgtttcttttaaacctagataatcctgttcaagctgtgatgacaaatgaccacgaacagttttatgagcactttgaatttttagctttaaatcattttcaatatactgataaattgatgtcttcaaatgatcaacctttaaattaggaataattgagattggcatataaattatttctaatgaatacggcttatcatctagtttgcggaatctaatgatatgatacacaaacgaaccctcttctatttgcaattttttcgatatcgtctcatcacttggaataacttcgaaagcaataatctcactatcaattttctttatccccgcaaaacgttctgttaatcctttggtaaaataattagatttattaggactctccatcgaaggattataatctttaacaaaggttccagcccctcgacgtcttacaatcaatccttctttaactaaaatatctagtgcttttttcattgtttctttattacaatggtacgttacacacaatacatattcatacgggagtttttgtccataggtgtatttctcttctattatcttggatctaatatcatcagcaatatcgatgtattttaccatggctacccctcctctatctagctctctttaaaaataccatacttttaataaatttgcacggactttttttagatataaaaaaccattaaattaaatgtatatttttctcaaaatgaaaaagcctcttatcgagactttttcactattattattttgcatcaataactttaatagctgcttctaatactttttctccattcatcattccataatctctcatttcaattacttcaattggagtttctgttttagttctaagaccttttaattcatgacgtacttgtggacctaacatcaccacatcccaatcatccatcttagataatgcatcggtaattggcaatgcgataatttctgcttcgattcctttttcagttgcggccttttccatccgttgaacaagcatactagtagacattcccgcattacatactaatagtatcttatacatcttatttcctcctttcctttaacgtccttctatattatatattataacactttaatctttttattcgaataatatgataactatttactaagacaatttattacaaatattttttactcccaagaatataaaaaatcgcaattattgcgattttctaaaatcaatctttttaactaccgtttgatcaaaatctttaatcataaaagtatccttttcataaataccatagctattctttccctctttaggcaaagaaatcgacgaaggattaataatatagataccattaatttccttagcaaccggtttatgaatatgaccatacacaaaaatatcaccatcattcaagcctggtaaattatcctcatcaaataaatgaccatgcgttaaaaagaaatgatgtccatctacatcaacagttgcaaaatcactacggatcggaaaatccaaaaccatttgatcaacttcagcatcacaattcccacgaactgcgataatatctttcttgtaagcattcaatagcgaaataacttttttaggagcatattcttcaggtaaatcattacgaggcccatgatataaaatatctcctaaaataattagtttatctgctttttcctgcttatatgtatcaattgctttttgagcatacaaagatgaaccgtgaatatcagaaataaacattaatttcatagaaaaacctcctctactggatatcgtacaattgtcttcaaatcttctggcgctactttttcaggtttatttaaatatatctcatgatgaaaaccacttaacttaagattcgccaccgttatgtattccatgatctgtttagttgaattgatttccgtattataaggtccaatgtgcagcatttgaatacatttaccttcttcaaactctttaagatatacgtctaatgctaaacaattacccgttttcgtcaacacttcattcttcacttcttcaagaatatgatcagttaaaatcggtggctgtggcatcattagtgtatatttaatcatttttttacgtgtaacatcaaaatggctattatcataggtgtcccaaataccttctaactttgaaccactaaatacaatctcttgctgacaataatattcttttaaagccttattaaattcaaataataattttgatttatttttaaattccggcactgtcggattcccaattccatctattgcaatatatttgatcatcggaatagttaaactacttatctttttagttgttgctcgatataattttggatattctttttttatatcaaattttgccattacatcatctccctgctctaactattatattacttttaaaaaaaattactatcgaaaattagaaagaacacattaaggtgttagtagacaaaaaataattacgatatactttatttaaagaaatacattaaaaacaaatgcaaaaagtataaatctttatataataatacaaatgataactttcatataatattattgtttttctcataatttgatttatctagtatcaataatatcgaaaaagaaaagatataataaatcaaatattttatattatatcaaataatatgttaaaaaattaatgcagctttgttgtccataatagttctaatggggatcgttgttccattatcaaaaccaaatgtttacgcaaatgataatatttgcccagccgctattgaaaatgataattattcatctactagagaaacaatatattataatgataatgatttttcaagtagatataaagttttaaaaaatggtaaaaaatattatatgaaaatattagatatttgggaaattgttattaactcaaaaggatatttatgcaattcatttatgataagatttcaaaaaagacatagttatcaatgataaaaaacaattgacatttctttaaaataggactattatgagtaaaaataaacatccaagtacaaatgcaatgacagggaagagtaaataattatggagttttagagaaaagatggctggtgaaaatctttacaacataattattgaaggtagccttcgagcagtgaatcgaacaaggaaacttaagtagacttcaacgtatttcctacgttatcaggatagtgtatcgagtatttaactccgtacatgaagcaagagccaaagaaatttggaaattaggtggtaccacggataatctattcgccctagcataagtgcttagggtttttattttatctaaaggaggaaatttaaaatgaaaacatttaattattcaactcgctctacccgacccgattttcaaggagattttttagacatgatgctacaagcgactaacaagcctaatttgatttctttcgccggtggattacctaatcccatctcttttcccactcaggaaatggcagcagccacacaaaaagtacttgatcagcatggtacaatcgctatgcagtatagtattccagaaggatatttacccttacgtcaatttattgcacatcaatatttgaaacaaggaattgatattagtgccaatgatattattatcactaacggttcccaacaagcactcgatattttatcggcagtactgatcgatgaaggtgataaaattcttattgaaaaacctagttacctagctgcactccaagtatttcatctctataatccaaaaatcaactcggttactttaaatcatcacggaattgacctacaggaattaacagcatatcttgaacaaaaaccaaaattcttttatgctatcccgacttttcaaaaccctaccggtttaacttatgacaatgaaacccgaattgctctagcaaatttgcttaaaaaaactaacactatctttattgaggacaacccttatggtgatcttcgttttaacgatgaaacatttttacctatttatcccttgctaaaagatcaaacgatactgctcggaactttctcaaaaacagtttctccaggtatgagaataggctggattgcttgttcaaactcttatttaaagcaaaagctcttagcctataaacaaatcgttgatcttcatactaatatttttgggcaaatggtccttcatcaatatctttgtgataacagtcttgaacaacaccttgaaaaaataaaaaaactttataaagaacaagcggaacaaatgataactagtattcaaaagtatttccctgctgaagttaaacatacaattccccaaggcggaatgttcttatgggtcacattaccccaaaaactaactgctgtcgctctagcaaatgaagcaatcaaacatgacatcgcaattgctgctggtgatcctttctatgaagaagaacgaaacgtttcaactctacgattaaattatactaattgtgatctaaaaacaattgatcaaggtattaaaatacttggtcaaattattaaaaatctcttagcctcttgagcgaggctttttgtctatattacaataaaacatcaaatagtaataagattctttgattactcatacactatattaaatttaaaataaaaaggacaaactaatgtcctaaatattgatcaaatatttttttcaaaccatctttgctggcaacaccttcatgtaacttagtattcccatcaaacaaagctggaacataataataatcatactgatctgctaattcactattgatttgctcatcaatcaattcaatttcaatttgattatattctgggttttcatcttgcaattctttaatccagcgccgtgcattacgacaatgaggacaattttctaaaataaataatttcatttccttatcctcttttaatagttttaattacgattggctgattagggcaatcttgtatatttctaggagcattagcaatttgatcaacaacctctaatccttccgtgattttcccaaaagccgcatagtcaccatcaagatgaggagcatcagcatgcatgataaaaaattgtgatgatgctgaatcaggaaccattgttctagccattgataatacaccacgagtatgtaataaatcattagctactccattacttctaaattcacctttaatactgtcagcctcatgatggttgaaatctttatcatatcctccaccttgaatcataaatcctgggataacacgatggaatattaaccctgcaaaaaaatcttgatcaattaattttaaaaagttttccacactaattggagcaatttcaggatataactcacctttcatcactccgccatcttccatttcaataataatatttactgtttccattctattctcctttatctactattcttgcttcaattatttcattagcaacttttttatcttttctttttttattaaagatcaatcctgcaatcagtaagattgctaaaattacaagaacccaaataattgaactaactaatttaaattgataagctgttgctacaatcaaacataaattaattatctcaaaagtccctgataatttccgtcttccattaaccaaaaaattaagggctaaagctgtacaaacaaacatccctattactaaagcgacttccataaataaccctccttcatcctttcttatcatatcatgattttgacttccagagcaactatcgtgtctccagactaataaccatgtactttgagcatattaactaattgaacataaaattcccgaacatcaaactcagcaatattctcacgatttaaatctatcatatcaccatgcgatattcctcttttcgtatttgttgttaaaaaagtataatcacaaccccaaggaaatgagttttcagccactaatccatcattaggcccatcaaaatacttcactaaatgatgcgaaaaattaagcggaaagcgacctcctgaagcaacatttagtttcgaaccaacactttgataaaatacttctgccacatcaggaacatccgcattgaacttttgacacgttgaagcagttaaatcattgaccgcagcaataaaatctggattctcgtccccaaatttcttaagggctgtattatatccctgagccactttttgtttaattttttcagggattttttccaataaataatctgcaaatatgcatcctcgatgtggagtattgatcgtagtaagtgatgccacatatggcgcaatattcagctttgcaatcgcataacgacaatctaaaccacctttagaatgtgcaataatatttaacttttcacacccgctttcctgtacaatttctttgattcgctttgctaactcatcgccactagcaataacactagctgctgactgatgattaccataataaatgaccgctccattttgttctagttcctcgggaattcgtccccaataattaaaatatttaaaatctctaaaaaacactccatgaaccaacagcaatggatattttgttttacacagctgttgttcttttctaactccatttaaaatagttttttcattttcaaatataatttcatcatcagcaattttaataagctttcttaaaataatcaaattaacaagtggaaaccatccccaaacaaccccgattatgcgccatttagctcctaattggttagccgttaaataaattctaataatgccattccaaaaaacaacagcctcaactattattaccactaatagattagttaaccatgcgccaatatctactttaaaaaatgaataaagcatataaacaattgtcattattaaagatattaaaaatatttttaataattcacaccctgctttacatatgcgatatcgtttcaaaagaggtctaggataagggacatatggtattgcattaataactataaaaatccccactaataaaccaattaacaatacgtttgaaaaacctaataacaacctatttgccaacacaaaaactattgttgctgataccagtcttattatatatttcataatttttccttatctcttatatttttacttattatactgccaaattatcattagtacaattatgaacaaaaaggtttatttaaaatgtcattcattgaaatcttaacttattgatttatataataaattttataaatcaataaaactatctattctcccgtcagatttcgtctatcaatcatgtatttatatacaaaaaagcgattaatcttaacgactaatcgcttgatatcgtcttaaattataaaatcagcacctattgctcaacaacgatcgtaatcatggcaaaatcctctgttccaatgttaataatgctatgtttagaatcttctttacaaatatggcagattcctgcaaataaactttcttcgtcatcatcacatatggctttacccatccctgatacaatataattaatattattgccagtttcatgcttatgcataccaaaagaaatagcaactaaaaataacttttctatttgaatctatatacattttagcatattatcccccctgcagaatgctgatttatatttataaactaagaatttttaatcctttctttttctttaatacaacaaatatagtaattagaattccggctgcaacaagtaatgatatatgcaaaaaaagcagacactatcctactgtctggcaggatcgcagttttgaacatgactgtcaactcctttttacacatattttaaaagattttcttccctcaatcacatttattttaccttatcaaaaaaatttatgtctattatttatacgtacaagaaaatatttttcaaaaaagtctccctatcccctatttattccatcgctaattgtaaaatatccatctatatcaatcataattaaaaactctattacaattaatcttacttccaaatttatcatatcatgattattcataagcctacagcttgctattaaagtaaactatcatttttatttgataattatattttctacttaatccaataggtgaagtcgtacaaacatggtaaataaaaaattatttttatttgatataatggtttaaaattgaaatcttttttatcattttatcaactgatataactaaaagagcctttcataaaagaaattgatattgtataatggttaactgaaaaatgataaaaaatatgcaaattatttgatacaaatttatattggggaggttttaaataatggaaaatttgaatataagagaagatgtatcagatattgttaataaaaccgaattattagcagatttgcaaatcggtttttggataatagaatatcctaacgacggaattccaaagatgtatggtgatacaattatgtactcgttattaggaggaaacagcaatactctgacaccggaagaactctattcattttgtatggagagaattgattctgaatatataggattagtttttgatgcaatcgaaaatataaaaaagaacaaaagaaccgaaatacggtatccatggagacatgaagaaaaagggtggacatgggttcggtgtggcggttttcttgataaatcatataaaaatggaataagatttaaaggctattatcatgatataacagaagaacttgagatggatatcaaaaataatgagcacaaaataatcgatttcaaaaaattacgattatattcaccttactttatcgaaaattgtgaaggcctttttgaaattgatatagatagtttagaaataaagactattttttataaaaagaaaaaatatcataaaattgatgatggggataatgttttttctgttataagaaaatggacacacccaaacgatattacacgtttagataatatttttgtatctgcatctctagaacaaataatcaataaaaaaaagttaaaacaaattgagtttaaaacaaaaacaatttttggagattatacttgggtagaagctagaatattttgtgcccaagtaatgggaattaaaaaattattattttatatttatgatatttctgatagaaaaactatttcctctttagtaaaagaaaaagaagaaatattagatgctttttttaatctatattctacaattgttgaagtggacttagctactgaaaaattacatatattaaaatctgttttacctaccaataatgatcatgatcaaaaaatattttcactaaaacaatttcttttgctacttgaaaaaagattaattatcaactttgaaaaaaaagaattagaaaactttttaacaattgataatttaagattactttctaaaacacaaaaaacatcacatcttgacctacgtttccaaaaggaactagaaaattatgaatgggtccaattaaaaactctctatcttcccaagaacaatgaaaaaatatatcttgtatttagtaatgtcgatagagaacatatcattaattcaattacagaaaaatttgtttataaaaaaggggattatttgtattatcttgatacaaaaaatggctatttttctaatttttcgataactgataacggtactgtcattcctcctcaagaaggcaataattatactcaagcaatgataaaatacacacgacaaaataccgttttagaagatcaagacagagttatcgaacaattgattcctgaatatatacttaatcgtctgcaagaacaaagtgtttataaaattgaactaggtatgttagatgaaaataaagaatatcggagaaaattaattactgttcaatattatgatgaagaaaataaaatcgtacttattcgaagaagtgacattacaaaagaatatcttaaacaaaaaaatcaagaaaacaagctaaaagctattaaaaaagcagctgatacagatgcccttacaggtatctataaccggattggtgctcagcgtttaatagtagaatatcttcataaatcaaataatcaaatgagtgcttttattatcattgacttagataattttaagaaaatcaatgatagtttagggcatttacaaggtgatgaagtattaaagcaggtagctaatatattaaaagaaaattttcgaaaaacagatataattgctcgtttgggtggtgatgaatttattgtatttatgaaaaatattgttcaaaaagaaaatgccatcatatcattaaataacctgcttaaaaaattacgattatcttatcaatggcatgaagaaacaattctaataactggttctattggagttgctgtagcacctatagacggggcaacttttgaagttctatataaaaatgcggatcaagctctgtataattcaaaatattcaggtaaaaatggatttagtttttataatgaacactaatgaaagtttaagtcaatataaagatcaaataaaaagaaactaaaaaacctaatttaaatattaggttttttcatctatattcttttttattaataccttatttatgatatgtttcgtttttcataattttaaatgcccgatagatttgttctactaagactagcctcatcaattgatgcggtaaagtcatcttagaaaaacttagcctaaaattagcacgatcaagcatttcttcaccatgaccaagtgaaccaccaattacaaatgcaatcgtacttttaccagaaatcatggctttttccatcttatttgataattcaacagaatctatttgcgttcccgacacatctagcaaaataacataatcatcctgcttaattttatcaagcatcttacgcccttctttagctttaattaatgtttcattggccagtgagcagttatccggtatactttcatctgctacttcataaacttctactttgcaataggcctgcaatctctttaaatattcctgcattcctgccactaaatatttttcttttaaacgcccaacacaaactattttaatcttcataattacctccgctgaccacatcaatttggctagctactttaatattatcgaactctagattattttgattaaaaatcttacgataggtttctaatgccttctctttagtattagcttcatcactcaaatgcgctaaaacaatttctttagttttatcaccgattaactctaccatcatctttgcactatattcattgtttaaatggcctagatcaccatgaatacgctgttttaaaaaataaggtcgtttcgttgccatcagcatctcaacatcatgattactttcaataatataatagtctagattattaagatatttccgatttttttgagatacataaccagtatctgtcatatacaaaatagattcattcacaccagtaatgataaaagccagcggacttgtcgcatcatgagatatacttaaaggcatgatttcaaaatgagctaattgaaaacttttatatggtttgatttcatggctgctatcgattcctttgatacatcctttaccgcaaaaacagattctttgatcaaatatactaatatttttattatggtcgtaatgatcgtgtgttaataaaacataattaatattactttcttgaaaaccaagattgccaagtttatataataattgttttctagcaatcccacaatcaatcaatattcccacaccattatcataaataaaggtactgtttccttttgaaccacttgctaaaatatgaaattccattgtcttctccttttattgttttattatacaaacttgtatgcacaaaaacaataaatttgtcttggaaaaagcaggatgtgaaaatattgtcattaattttaaattttatgataaaataagaatataaagggggattttcaatatgcctagaattattactattgccagagaatacggttctggcggacgcttaattgcacaaaaagttgcgcagaaagtcggacttgtatactatgataatgaagtcatcgacttggcagctcgcgaaatgggaatggatgttgatgcaatccgtaaagtagctgaacaaaaatcatctagctttatgtatacaatgtcatcttccgctttttcattaccactaaatgatcaggtttttgtaatgcagtctaaaatcattcgtcatttagctaatcatgattcatgtatcattgttaatggatgtgctgattatatccttgaggattatgatgatgttttatctatttttattcatgcaccactagaatcacgaattcgccgagttaaagaggattatcaagaagtacatgatgattataaaaaatacgttactaaaagagacaaaggtcggagtaattattacaattactatacaacaaaaaaatggggtcatttaaaaaatttcgatttaacgattaacagtgatttaggaatcgacgaagtcgcaacgatcattgctgatttgtttttaaaaggagaaaaatagtgatccaagaaaataagatgggaacaatgccggtcaacaaactgctaatttcaatgtctctaccaatgattatctcaatgttagttcaagcaatgtataatatcgttgatagtgtctttgttgcccaaataagcgaaaacgctttaactgctgtttctttagcatttccattgcaaaacttgatgattgcctttgccgggggaactgcagttggcgtcaatgctttattgtcacgtagtttaggtgagaagaatcaagatcatgttaaccagacagcagttaattcagtatttatttttcttgtcacggcggttatatttatgatcgccggactaacattgtctaacctcttttttaatgttcaaacaactaatactgaaattgttaatgccggtacccaatattcaatgatcgtagttggctgttcaattggattgttttgtcaatttctatttgaacgattattacaggcaactggaagaaccctgtttactatggttactcagggattaggtgccataatcaatataattttagaccctatttttatttttggtttatgtggctttcctaaaatgggtgtcgctggtgctgcacttgcgacaataaccggtcaaatcattgcttgtcttttagctctatttttcaatcttaaatttaatcatgatattcattttaaatttaaaaggtttcgacctaatgctcatattgttaagcaaatatattcagtaggaatcccatctatcatcatgcagtctatcggtagtgtcatgacttttggtatgaatactatcttaattactttttctaccacggctactgcggtttttggtgtatacttcaaattacaaagctttgtctttatgcctgttttcggtcttaataacggtatgattccaatcattgcctataatcttggggctaaacaaaagaaacgaatgtttgatacaataaaattggcaatgatctacgctactggcatgatgatcattggtgttatcttctttgaaacaattccgcaaactcttttaggtttctttaacgcctctgaggcaatgataaaaattggaacaccggctttaagaataattgctattcatttcatttttgcaggtttctcaattgtttgtagtgcaactttccaagctgttggtaaaggtacatatagtcttttaacttcgttgatcagacaattattagtattattaccttgtgcttatgtattatcattaacaggtaacttagacttaatttggctatgtttcccgattgcggaaattttctctgcagtgacttcttttattttaatgaagcgaacccgtagacatttagaattttaagacttatgaatcttcataagtctttttttgcagcaaaaaaggagcttgcgctcctttacttgtgtaattatttaagtccgtattttttattgaatttatcaacacgtccatcagcactagcaaatctttgtttaccagtatagaatggatgacagtttgaacaagtatcaacacgtacttcgtctaaaactgatccaccttcaaattcgtttccacaagaagtacaaacgatttttacttttttgtaatctggatgaattccttttttcataaatatcaatctccttccgccttatagcatatagctacaaagtaagttgctttagtataataacattaaaatatctagatttcaagtcatttttttaaattaatcactaatcttcgacttgacgtctagtaatcacagctccaagtgaaattaacttatgatcaatattttcatagccgcgatcaatatgataaacatttccaatttcagtaacaccatcagccattaaagctgccacgatcaacgctgcaccacaacgtagatctgtcgcataaacacgtgctccatgtaatggcgtaggaccattaatataacacattgcttcttcttgatcaatttttgctcccattgaattcagctgataacaatgtccaaagcgttcaggataaatcgtttcaactacttgtgaagctccctgacattgagttaataacgctgttagcggttgttgtaaatcggttgcaaaaccaggatatacctgtgtcctaatatcaattggttttaaattatcaaggccgccatgaacaataatactgtcaccaacaatatccattttaaccccgatttcttttagtttagaagttactgcttctaaatgttgaggtataacattttgaataattactttttctcctgccgctgcagccatcactaaaaatgtcccagcttcaattcggtcaggaataatttcatgatcacaaccacaaagagtttctacaccttcaattgtgatcgtatctgttccagccccacgaatcttagctcccattttcgtaagtaaattaacaacatcaataatttcaggttcctttgcagaattttctattgttgtttttccttctgctttaaccgctgccaacaggatattgattgttgctcctactgaagcaaaatccaaataaattttattcccaactaaacgatcagcttcaatcgtataggttccattatcactataactaacttttgcacctaatgcttcaaatcctttaatatgtaaatcgattggtcgtggtcctaaaaaacacccaccaggcatcttcatcgtcacttttttgcattttcctaataaagctcccattaaataataagatgctcttaatttatcaactgcatcacttactaaaggtatattttttaagttagaaggatcaaccactaacacatcatcatttttatctacttcacagtttaattctcttaacaatactcctagtgcatcgacatcagaaatatttggtaccccatatactgttacaggactatctgctaagacaatcgcaggaattagagctaccgttgcattttttgcaccgcttaccaccacagttccattcaatttgtgtccaccttcaatggcaattacttcactcattttagtcctccttaaaatttaatctacgtaactactatatattaatttattgttaaaaacaaccaaaaaatgtatttttaaaagtttcgaatttttttgacaatatctaatatatttctattttcaaaacataaaaaaatctaccaaactaatattaactcaatattaacgaaaaaaagaaacctttatgtaaatagcttctaatttttctatatttcattaaaaatactactctattatcacttcaaactaaccttgattaattaaattaaaagcagaacaaatctgtttacaaataattaaagcaaaaagataaacaaacataaaaatgactgatgaatatgcttcaattcataatacaattattaaaaattatatatgtctttttgactatctttttatatcttcttaaatgtccgcaaagccttattttataggctctacgggcattttgcttttgtggtaaacctcacatatctaggtctatcttcttatattttcactatcaagcgtggttaaaatcgtggtaaatacttctatgcaattagacgctgaacctctgattttgcggtatctatggacgcatgagcataccagttcattgtgatactgatatttgaatgccccatgatatactgtaaatcttttgggttcatgttcttgcttgccagtcttgtgcagaatgtatggcgtagcgtatgcggtgtgatatgtggcaatggattgtccttgtggtgcttgttgtatttctttaccatacggataaataaggcgttataatcaatcgcaactttgggcttgcccttatgattgacaaataggaagttgccccgtccgtctatcacaaatggttctgcctttggacgttttttcataacctgttgaaatgcctgtatcgtttctttgcttaatggtacttgccttattccgctttttgttttaggcgtttcaatataatagccctgttccttgctctttagtaactggtggtcgataatcacaacttcattcttgaaatcaatgtcggctactgtcagtccgcacagttccgaaatacgaagtcctgtctttaacagtatcagcacatcatcataatgcttgtgatacacattgtccgtcttgatgaatgagagtaaggcttgttcctgttcctctgtcaatgcgactttctttttggtatcattttctaggacttcactcaacttgaaatcaaagggatttttcctcacataatcatcttgaatggctatgtagaatgacgcttttaacgagcgtttatggttgttaatggtattgtaggaaaagcctttgtctttcatgcgtaacgcccattccttagcgtcagagggtttgattgtatcaatgctcctagcacctaacttgtcctctttcaataaccgcatgagttgttcccgttgtttctgtgtgcttttcttcacatttgccctctgtgcgttctgtttggcataaagttggcaaagcgtcattttcttgccagtgctgtcgataccgtcctcaatatcccgtcttatctgctgttccagttctcgaagtgagggtttttcccgttttccctttggtgtcgggtctgtgggtgtcaatctccaagcatacacatattttgtgtttccaaatgcgtctacatatttatataagtattttctgtctgttcgttggctctctccagtatgcaggatacgacctttgttatcccgtcttttttctttcatggtgtctgctcctttccttgttggaaagagccttgatatgacttgtgttcatcataacacatacaaggctcatttgcattagatagcgtccaatttatcaatgacctgttcaaactgtcggcgtttaatctgtatgcggttgccattcataatgagccagccagcgtccttgttttcctctgccaatcgtcttaacttgttttctccgatacggaaatactttgacgcttcttcaatggtaagggtgtatttttcccatacgggaatatcctgtgcattactcataaaacaccccctcactttcgattacgtctgctatgtccgtacacatctgttccacaagcatttcctgcttttcagagaggtgggtacattcatcaatcattttcatgtagtttgagcctgtcagcctgtcgatttcctctatcatcacgattgacggcatgacctgtctttccagccattgcagagtgcgttccatattgacaggtacggggttcatttcaaaaggtaaactgtcatgggaaatgaatatctcccacagcggatagtcgggaaattgcacaaaatcagtaataaggtaaaacaccagcccatgagggttatatgtcaataacaattcctcaactgcctgtactgcttttgtaccacgcagacgaatttcaaaacgattgataatatccgtatgtttctttttggttgcctgttccttttgtttttcatacaggcagaagtattttgtgcttgcctttgaaccgatataaagggtgcttgctaaattacggttttttccgcttagttttccaccctgcacattttcataatttttacagcgacaatccgcaccgccatttctgtatttttcagacaaaacgggaatatccaacagaccacacatatcattgattgccaagtcaaaacgtcggataacaccgtcacagtcaagacagcggtttaaaaatgaataccaatctctgttctgtgcctgcaagacatattccatgttgcgtgagcctgccccttttaattccaagaatacgcccatgtgttcgtcatcagaagccatgaccttgatttctccgtaggcgtaatgctctttatagccataatacccatagtcataatggataaaataatctgctttcatgccaagcacctttcggataatttccaatgcgtcagtcgttggataacggacagacagataatcaacgagcagataaaaaggcttatcgcagatataataattcagacaacgcaggataatattttgtgtttccttgctggcgttggcttttccgttctcaaagcggttgatactatatcttgatacatgggtaagacttgcaagttctccttgtgaaagaccgcttgcaagacgtttgttcttcatttcaagtgcaaattctaaattgttcattgtattcctccaatcccacaatagccttgaaatacctgtaaacctctattcaaaaagtgtgatatgcactatcttcttaaaacttctcattactactcacaactttgggattgtatggtttttgacttgtcttttgtgaaatagtgcccccctgttagataacgggggcacagacaaggctcgcaggctcgccagccgacaaagcatttcttccccttgacacaaggtgtcatggcggtaagcctgagaggcttccgccaccgtgtcagaaatactttgtcagcaagttctgttttgccttttctaacaagttccatttcaaccgatattcatatctacggatttaatcagataggtatttctttttgaatgtttttatatttcattctattgtgcttattcgattacaagaacatagtaattcttatatgcttatttgtcaatatctttttttgcctttacaaatcatattaagcatgatagacttataatagcgaagatataacgagatatggagggttatgcaatgaaaataagccatttaggaaataatatacagaccataagaaaatttaggggaatgaaacaacaggaacttgcggacaaaatcggtatcaatatgcagagcctttccaagattgaaagagggttgaactatcctgcctatgaaacgctggaaaagataatggaagtgctggacgttacgcccaatgaattgttgtcgggagaatggaagtatgtcaatcaatctgaaaaggaagtctgtcagtttttaagagccgaagaacgtctaaatgcagaactgaaacatggacactatgataacttctttgacagcgaggaagaatggctggaatatgagttagaaaagttacgggaatatattacagactatatcaacgggaaaagcattgaagcgtccgacctttacccaatcaaagaatttatccagcatttgaagtttcaaaaattattagaccgctatgatgatttatacagtatggatatgtttggggaaagcatagagggacataagtataagacaccttatcaagtcgtgaaaatgataaacccgaactcaaaagaagatatggaactgttacgagaagtattaaggaataacaattttgatgatgaggacgagtaacttttttcctcttgcgagaagatacagcaaacaaaaagcccgatcaagagtgcaaagcaccaccaatggtggcaaagctcttgacagggctttttcttttctgttgtgggcaatcaagaggaagaaagggataaaatctgatttgtggtaaatcaggcaaaggcaacgcaggtatctcaatttgatttggtacttgaaaagaacgggagtaattggaagattatagaataacaaatattggtacattattacagctattttgtaatcacgtactctctttgataaaaaattggagattcctttacaaatatgctcttacgtgctattatttaagtatctatttaaaaggagttaataaatatgcggcaaggtattcttaaataaactgtcaatttgatagtgggaacaaataattggatgtccttttttaggagggcttagttttttgtacccagtttaagaatacctttatcatgtgattctaaagtatccggagaatatctgtatgctttgtatgcctatggttatgcataaaaatcccagtgataaaagtatttatcactgggatttttatgcccttttgggtttttgaatggaggaaaatcacatgaaaattattaatattggagttttagctcatgttgatgcaggaaaaactaccttaacagaaagcttattatataacagtggagcgattacagaattaggaagcgtggacaaaggtacaacgaggacggataatacgcttttagaacgtcagagaggaattacaattcagacaggaataacctcttttcagtgggaaaatacgaaggtgaacatcatagacacgccaggacatatggatttcttagcagaagtatatcgttcattatcagttttagatggggcaattctactgatttctgcaaaagatggcgtacaagcacaaactcgtatattatttcatgcacttaggaaaatggggattcccacaatcttttttatcaataagattgaccaaaatggaattgatttatcaacggtttatcaggatattaaagagaaactttctgccgaaattgtaatcaaacagaaggtagaactgtatcctaatatgtgtgtgacgaactttaccgaatctgaacaatgggatacggtaatagagggaaacgatgaccttttagagaaatatatgtccggtaaatcattagaagcattggaactcgaacaagaggaaagcataagatttcagaattgttctctgttccctctttatcatggaagtgcaaaaagtaatatagggattgataaccttatagaagttattactaataaattttattcatcaacacatcgaggtccgtctgaactttgcggaaatgttttcaaaattgaatatacaaaaaaaagacaacgtcttgcatatatacgcctttatagtggagtactacatttacgagattcggttagagtatcagaaaaagaaaaaataaaagttacagaaatgtatacttcaataaatggtgaattatgtaagattgatagagcttattctggagaaattgttattttgcaaaatgagtttttgaagttaaatagtgttcttggagatacaaaactattgccacagagaaaaaagattgaaaatccgcaccctctactacaaacaactgttgaaccgagtaaacctgaacagagagaaatgttgcttgatgcccttttggaaatctcagatagtgatccgcttctacgatattacgtggattctacgacacatgaaattatactttctttcttagggaaagtacaaatggaagtgattagtgcactgttgcaagaaaagtatcatgtggagatagaactaaaagagcctacagtcatttatatggagagaccgttaaaaaatgcagaatataccattcacatcgaagtgccgccaaatcctttctgggcttccattggtttatctgtatcaccgcttccgttgggaagtggaatgcagtatgagagctcggtttctcttggatacttaaatcaatcgtttcaaaatgcagttatggaggggatacgctatggctgtgaacaaggattgtatggttggaatgtgacggactgtaaaatctgttttaagtatggcttatactatagccctgttagtaccccagcagattttcggatgcttgctcctattgtattggaacaagtcttaaaaaaagctggaacagaattgttagagccatatcttagttttaaaatttatgcgccacaggaatatctttcacgagcatacaacgatgctcctaaatattgtgcgaacatcgtagacactcaattgaaaaataatgaggtcattcttagtggagaaatccctgctcggtgtattcaagaatatcgtagtgatttaactttctttacaaatggacgtagtgtttgtttaacagagttaaaagggtaccatgttactaccggtgaacctgtttgccagccccgtcgtccaaatagtcggatagataaagtacgatatatgttcaataaaataacttagtgtattttatgttgttatataaatatggtttcttgttaaataagatgaaatattttttaataaagatttgaattaaagtgtaaaggaggagatagttattataaactacaagtggatattgtgtcctgtatgtggaaataaaacacgattaaagataagggaagatactgaattaaaaaaattccccctctattgtccgaaatgcagacaagaaaatttaattgaaataaagcagttcaaagtaactgtgattacagagccagacgcaaagacgcagagccgataaaatgagattaatacaatctcattttatcggctctttccgttatgtatggattcttttaattagtcttcgatgtttcttgcttcgttgataccgctggctaaagattccattaaggatagttctttgtctgtaaagctatccatgtatttctctatctgtaatcgtcgggtgctttttaccaagttattagcaggtaagaaaaattcatcaacggaaacatgaagtaacgatacaaggtcataaagaacttgtatgctggggtgttgccctttattttcaatattagttaagtaccgtgggtcaatttcaatcaatgctcccacttgttcacgagttaaacctcgtttcaatcgagcttctttaatggctaaaccaaaggctctaaaatcatatttatcttcttttttacgcatagtagaccacctctatacattttattgttcctactgaattaaaaacaggtatagaaaaacgtgttatatggtttataggtttatatttaataaaaagcactactaaacgccaataaaaaaaaccgttatatggtagtgctatttacgctgttaaaatattgtatattacttccaaatggcggtttgttggaggtcaacgtcgccatgaagtacatcatatacaataaatttccttacattgggttcttgtcaaaaaaagtcgtctatctgcaatagataagtacgtccaccaatgtggttttataaatcatatagatagaataacagaagcatgtaaacagagaaataaatctgtttatatgcttttttggctattcagaacttttttacaaagtttatttatcagtaatgcaacaaatccccctttcacattgggactaagagtgaaaggagataaacgagcaaggctcacttcctttcctagacagaaagggggtgagattatgaggacatcttctttcgagcatatcgtcagattacagttcaattctttaatgctgattgtcattaagaacaaagtgaaaagtcgaaacagacagcttgcaagacattctaaacgtgaagtattgttttgtgaaatagccgaaacgaaacaagttgaacgtggaacgattgatacctgtttttatgattgtgtatcatttaaagtcttgcactttacaatttatgtatctgatgaaacacttggtacagttttacatagactgtcagaaaaacagcgtagtgcgattttattacgttattttcaaggaatgaacgacagagaaatttcagaactgtaccatgtatcacgttctgctatttgcagtagaagaactagaggactaaggaagttaaaaatgcttttgagcgaaaggaagtaaagattatggctatccctcttttgaattgatttgcaaagcgtcaagcggagatgaaatggcagttaaagagattttgaagttttatgacggttatatttctaaattatgcttgcgtcctttttaccactctgaaagtggtaaaatcattatgcaggttgatgaagaactaaaaggagaaattcatacagacatgatgaaagcaatattgaaatttgaaatcggagtgaagtaatcaactgtataaaaaaatcgggagatacacagtttcgtgttatctcccttagtagttttacggtcatatcaaggctcattcaatcgtggtaaattcgtggtaagatgagtgtttttctatacttcaaaatgcttgaatgtatagtgtttatgcggataattgaaaattagatataaaatttattaaagaatttattaatgttatacaatcatctttttattaactgaaagtattcctttacaccctaatatatttacgattttagcaactttaaagtaataaatatccaccggcttagccggtggttttacatttgcgggcatagccctgctctcagagcgcatgtctcaagacattccttatgcctacggctaccacgtgcactctgtatttatttagtttttcccttttccttttttaaacgggtattccaaatccagtgtcagctgttctctttcctgatcttcttttaattgattcgctatataattttttattcttttcgtattctttcctactgtatctacataatatcctcgacaccagaactctctatgtctgtacttatatcttgtatttgcccatctttcatatatcatttgactgctctttccctttaaaaaccccataaaccctgaaacactatatttgggcggtatttctactaacatatatacatgatctatgcatacttccgcttctattatatttacgcctttccattcacataattgtcttagtattgctcctacctctacccttcttgcttcataaaatgctcttcttctatattttggtgcaaatacaatatgatatttgcacctccattttgtgtgtgataaactatgtaagtcatctgaatactgtttattcatttgtcatttcctcagtgatatcttatttttgcagttggtagccgcatttatattatatcacgtgaggtttttcattatcactccgctaaagctttttgagacccccagcctagctgggggttttattgcagacaaaaaaggatttcacatatgtgaaatccccattaactatagttataattaagctttaccaatgcaaccaaagatttccattttttctttaacacattcttggatagctgcagcacctggtgccaataatttacgagggtcaaatcctttaccttctaaatcttttccagcttcaatgtattttcttgttgcttcttggaaatataattgacattcagtatttacattgattttagaaacacctaaagtaattgcttttttaatcatatcctctggaattccagttccaccatgtaatactaatggtaatttaccagtttctttttgaattgcatctaatgcatcaaaatctaaaccttcccaattttctggatatttaccatgaatgtttccaatacctgctgctaagaagtcaactcctaagtcagcgatcattttacattcttttggatcagctacttcacctttaccaacgacaccgtcttcttctccaccaattgatccaacttctgcttctacagatacaccttttgagtgacataattcaacgatttcttttgttttttcaatattttcttcaattccataatgagaaccatcgaacatgattgaagagaaaccagcttctaaagcagctttagctccttcatagctaccatgatctaaatgtaaagctactggtacagtaattcctaaagaatctaccattgctgataccattgctgatacagttttgaatccagtcatatatttagcagcaccttcagatactcctaagattactggagcttttaattcttctgcagttaaaagaatagattttgtccattctaagttgttgatgttaaattgaccaactgcataatgtccttcttttgctttatttaacatttctgttgctgatactaatcccataaaatttctccttttctttttactcctatatattactattatttaattgaaatttccatagtaacacaaagtttttttgcctatttcctatatttttaccccattatctgagtcgtaagcgatttcttttttagaaaataaagaaaatgcagcatcaatgatgctacatcactaaaaaatagatatacacgatgaatagcagtgggaaacttgttgctactggcgggacataacatcaactacattttctccttatctataaaagattgaattattaaactatttggagaacaattaaaaaatcaatctctaaagataacatattaaatctgcgctcattatatcaaacaagatttgatacggttttattatattacattttattattatgtcaataataatttattataaacaaaaaaataaaagaccaccaccggtgatctttatattagctgtctattctttaacgcttgatataaattatctagagcctgcactaataaacagcgcggcatcgctaaattaaatctctcaaaacctgctccaccaacaccaaaaatatatccttcatcaagccataatttagcttcattgaccataaatgcttctaattcctcgtgcgtcatttgcaaagcactaaaatcaacccaaacaagatataacccctgaggtttaatcattttgagcattggtagttttttctttaaaaaaccatcaagatatttaatattgccatcaagataagccactaattcatcaacccacttatcaccatgattataagctgctttacacgcttcaataccaaaaattgttggttccaccggaaatcctagtgaacttttaaccttaataaacttttcttttaatttatgattaaaaaataatatattagacgtctgtaaacccgccagattgaaagtcttacttggtgctgtacaaataattgtaaattctttaaatgaggcatcaacattaacaaaaggaaggtgcttattccccttataaataaaatcttgatgaatttcatcactgactaccagtacattatgtttcttacaaatattacctaatttaaataattcttctttattccaaacttttcctattggattatacggattacataaaataaacattttcacatcattatcaataatcaactgctcaaacaaatcaaaatctagttcgtatgtttgaccagtaaacatcatcggacattcaattttcttacgttgattttcatcaatagaaaaatcaaatggataatacactggtttattaatgataatagcatcaccgggagctgtaaaagcattaactgcgattttaagcgctgttactacccccgttgttgttacaatattatctgcatttatatctaattgatggcgacgcttcatccaattacaaaccgcctcataataatcatcgccagccattgaatacccatacactgcatgtttagcgcgttcaataattgcctcagtaacttctggcaaggtttcaaaatccatatcagcaacccataaaggtaaaatatctttcggttttccttcttttttccaagtatcccatttaatacattttgtatttctacgtttgactattttatcaaaatcatacattcttacaatctccttataatccacttattatcgcaatacctgtttatctttgaattccatcattgaaaagtggcataacgtgattcctaatgccatggataaatttagtgagtcaattttatcactatgagggataaatacactttgcccatattttaaataatcatctggcagtccgctgctctcattaccaaaaaccaatgaatgtttattatttgcagcagtaatctgatgaatatttttagctccttttaacatcaatggatagacttcacgttcagggtatttagttagatattcatcaaaactattaaaatattcaaaattaatattaaacaaagcccccatcgatgccctaattactcgtggatcaaaaacatcgactccaggacgaataatcgctaaattagtataattaaaacctaacatagttctaataatcgtccccatatttcccatatctccgggattaactaaaacaacatgattagcatcttctaaatccatcgtatatttcttaatgattgcaatagcaaaacaattatcttttttcgctaatttattaattgtattatcactttcaattaattcaattttattttgttgacataaattctcaataatcttaacacccttattttgataagagttacttttgagataaacacgcatcaccaattctggtttattctctaataattcaatcgtttcaaaaaccccaagagtatatgtataatcaaaatctttatgatatgtttttattttcattttataaacctttcaataaatcaatttgctttttcaaatcctgctgcattgataaaaaatgtgctttatcaaaatcaacaccttgatcaattaaatctaaaagatcattatatttatcatatgctaattctaataacgagatttgaatttctaaatctaactcattattagcatcatttacaatttgattaatatctttatatttatctttaaatacctgttgcaaatcaactgtctttttcttcttaccaaaaaatcccatttcaactacctccattgttatttttataattatagcgtgtttacttagttttgaaaagtttgttatttttaaattgagagatgtttatataacttcccgaaaggaatcactggtgctggtttgcctggatgctctcctaacattttttccatccagatcatgtcatgccattgattaaacttatagccgcatttagtaaaataagccaccttttgataaccaaaatgttcatgaaacacaatactttctggattcccagcagtaatacaagcatttaaattaataatattttgctgtttcgtaatttcttctaatttatggtataacatactgccaattcctccacctttataatcaaggtcaatataaatcgatgtttctacagcccactgatatgcagcccgacttttaaatgcggatgtataagcatagcctactatcttatcatcaagcttagcaacaagatacggatacttttctaaagttgaaacaattcttgccctaaattcttctaaagttggtacttcatattcaaatgtgattgctgttgttagtacataaggtcgatatatttccaataaccttgcagcatcatcagctgttgcaacagcaagcctaattttcgtcattgataattcctccatttttctaagataaactgtataatcatgatataataatactaactttatcaaaggagaatagcaatggataaaataaaagatttatatcaagatgacctaatctacattttcactcgttcacaattacgtgacttaaacactgattacttggcaatcattaaaaatgaatgttctattcagacaatcaataactgcataacaatgcactatcaagatgatttcgaatcattattagctttttctctaccgactaaaaacagaaaaaacaagcagttaatttctttaaatcaatgctataaaatcatggataaaattcattacggtgttttatcattcacccatgaaggactaccttatagtgtagctttaaatcacatcattattgataaccgtattttttttcactgtgctaaaagcggctataaactaaacagcattgaacagcgtgccacttatcttatagttgaagatctaggtattaatttaaaagcaggaactcataaccataattccgtcgctgtctttggaacagttcatgaagtaactgagtttgagacaaaaaaagctgcactattagaaatagtcagccatttagcgccagaacacccatacaatgataagatggtcgatacaactaatatcatcgaattagaaattgattatattaacggaaaaacacatattcgttaattatcaaattcacaataaacaaaggtaatactaaaatacttcaaatcaaacagttcctagctgtaatgccctttaagttgttttaacaacagagcttattatatctaggagctttttaaattcacaactactatttcactgtgttttgcagttctcattgcatatccccagccacccattcctgaggtcacgatcccatgaaaattattatttacttcaattccatagttcaaatcattaaccctaataaaactaaataagaaatttaaaggaaatatttgtccagcatgagtatgacctgataattgtaaatcaattcccaattgttcatttaattcataatcatgtggctgatgatccaataaaataagcggtttagaagtatctaaaggttccgtcaaatcttttaaagcttctcgcttttttacaacatagtctttacgcccaattaaataaatatcatccaatttagtaacatcgtccaacaataccttaatccctatttcttttaatttcttaacaatattaaattccctaagtggtgagccaccttggaaaccaatttcatgatttccttcaatataataaacagggtatttactagccaatattttaaatacctgtaatgaataatcaaattcatcttgggtggtcccttcatcatagatatcaccaagtagaataatcccacttggagcaatagcttcagcatgttcactaagctctgttaaatccgccttagtgacaactgttcctaaatggatatcagaaactaccattaggcttttatctacaaaagatttattgattattacatcatacgtagtaataacagtatttttagcattataaattccataaaaacttaaaataacactggcagccaaagcaaccattccccgttgataaataaatttaaaataacgattaaatctagttttatataaaattaaattaataatatcaaagattacaaaacaaatacatgcattaaccaaaaaaccaaagaaaatcaaattatataaacacaagccgattaaaattccaataataactgttgtaataatctttcgatattttgctttagcaaaaaccaaatgtgtatgataagcaagatatactgtcataactgctaccaaagtcatctccattaaaacaaaccagctcataataaaatcatctccttagtaaattatatcacaaaataatcttaaattatctcactattgtcaataaaaaaactaaactaagatcatttgaaatcacttcttttttcgcacacttaagcttcaaaaatagtaatacattacaaaatctgtttagttttttatgttcttatttactaatcaaatcaattactacaatctcgcaatttttactagttctcatggcaaacccccaagtccccattcccgaagaaacgatcgcattaaaattatcatcatgacgataaccataattcatctcattaattcctaaaagattccaaagcggtaacatcggaaatacttgtccagcatgagtatgaccagagatcatcaaatcaattcctagctttttattttcctctaatgagcgaggctgatgatctaataagatcactggtttattctgattcatcccgttaataatctgttctacaggttttcgctttttaatcttataatcttgacgtcctacaatatttatatcctcaaattcaacatattcatcatttaaagtattgactcctgccaattgcaatcgttctaatatgttatgttcttttaatggggaactactataaccaacttcatgatttccaattacataatagactggataggatttagctaactgggtgaatattttcatcgaatcatcaatttcatcgctactggtattttcatcataaacatccccaactaaaaaaatcatatctggtttaattttctcagcttgcgtaacaagctgttttagatctactgttttaacagctgttcccaagtgaatatcggaaagtgccatgatctttttatccttaaattccttattaatacttacttggtaatttgtgattacaatattatttgcattatatatcccataaacactcaagcttaaactacaaataagtactccaataagataaactttttgatatggtcttttcaattttgtcttaaatataagcaggtaaattaaatccgcaattatcaaacaaatacacaaattgattaaaaatcctaaaattatcatttcaatacttacacttacagcaactaaaacaataattactgctgcaacaactctatgcttatttaaatattttttaaaatgatatgcaataaatatattgatcaagatagcaattactaccatcattacggttaaaatcaaaaactatccctcctttaagaataaattataccacagattatatttatggtataataactccgaggtgaaattatgcataaattagcgtgtccaaaatgtcatgaatcaatcgttcaagaaggaaattcatataaatgtgccaataatcattgctatgatctagctaaaactaaatatttaaatttgttattaaatcctgataaagctacaaataaccctggtgatagtaaagaaagtttagttgcccgcaaagcatatctaactaaaggatattatgatgtcattttaaattcagttattgactgtataaaaaaatatcgtgatgataccccactagatatacttgatctcggttgcggtgaaggatattatactcgaggattaaaagaaatctttagccaagacactatttatggattagatatatctaaagaagctatcaatatggccactaaatatactaaagatgtttattggcttgtcggtaatagtaagaacttacctatcgttgatcactcattagactttatcacagctctatttacagtcgtaaatcaagatgagctgaaacgtactttaaaaaagggtggttatattatccatgtaactgccaacccaaatcatctaattgaaataaaagaattaatatatgatgaaatcaaagttaaaagtgacaaatatattcgtttagattttgaaacaattgaaagctatgatctagttcatcaagtaaaaattgataatcgtgaagatgctttaaatttactaaagatgaccccccattattaccatataaaaaaagaacgccggggcgttcttgatgaattagaacgattagatattacaattgatattaaaataacaatatatcaaacaagcatcgattaaccgatgcttatttttattatcagtatgatttgaagtcctagaagtaaaggtattccatacttaaaaatatttttcctagtcttatgattaaatccatacatcgctaatatcgctcctagtgaaccaccaaacaaagcgcctattaatagtatcttctcagaaactcgccaatgatgatgaattgctttatacttatcaattccatataataatatcatcatcaagttaattataattatatagctgattaataatttcatcggtcttctgttatctccaaatagatatcgcgattcccctaacaacatatttcaagagaacctattaaatttttatagtgtttctttgcattatattaaatcattatttcatcaaaatatttcgttatttaatactatttttatcgataaaaaaaacgaaccatcttaacaacattaaaacgacttttttcaaaaagaatccgcgcaggaatccttttttcatcaccacaatctaaaaagataatatctagaccctttttagtttcttcgtaaccgacaatcgttacccagtgccataaatcatctcgaatcttacgacgtcgatgtgttaagatcaataatcctaaaggattaccatgctcaatactctctttaacaatttcactagcatcataaagtcttggacgtctaaaaatacgatactcacaattatttaacaatttactcaatcgtcttgcatataaaaagacatacggaaatccacgcttaccaggttccatcagcttgaacatttcattcatgtagtctaaatacgttgatttatcaaattcacgttctcttttcgtataatagataaaaatatcagtagcactaacacttgcacaaccagctttacgagcccaagagtcagcaaaccaatcttgattaccaccctgaccaatcaattctttctctttataaatttttggataatctaaaatcatcatgccaccttctttccatatctccattatacgttattatgtccaagttcgtcactaattagataaaaaaaagaactaaaattaagatgactttaattctctcgtttagtgccactgctatcatatttaagatactccacaatatcattacaacctataaccggactgtcgccttaagtcttacgagccaacacccccaatatagcagcataattaataagatattcatcatcataatgatgtgataaaccgtaaaaaacggtaagagaactacgattatctctaattctttaatcaataaacaatctttttctagcattcttaataaaaatggtttgcaactaaaaaagaagatataaaattttatttaatcatgttatctcctcaagctgaattatattcagcttatgattctaaatgtttaaaaattgagctaacttactgtcttggcagtgagccttatattcataaaattcattatttaccaaaaaattagttcttgatgaaaaaattgaagctgaaaatttttctatttatcgctttttgcatcaaaataattgtaaggtctgttttgtaaaaataaaaaagccctttgggacaagagctttttttaatatctgtattctatacgggaaaacgaatactattatagatatttgggacacgtttataataccataatatcttattaatagttttcaaatagtgaaaatcaattttcatataatgaaaattttatcaaaaattatctaaatagccacccatttcaaaatatataacactatcatcaatagatttgaaaacaactttaacatatttatcatcaaaataacgatatattttagcaattgttcccggagccatttcttgtttatataaaatacttacttctttaaaataatgttgttcaaatatccttagacccacagcatcaaatgcccattcaatataacgactattattcatatgttgatttacatcaacatcactatataaaacttgacgttccatgacataatccaatggcagttctttaataatttcatgatattcttcgatcgtataatcataagacttgatttctggcattataattcctgctttatcaggtttagtaattcttcgtttttctaaatctattaaagtccataatgagtatactgatgctatttcatcaccgttttcatcttcaacccaatagttacgtgtgaactggattcttttacaggctgcggcacgagtttttaatcttattttttcatctatcttaattggtctttttaaaattaatgtttctttagctaaaacaaaaccaaatcgttcccctaactccggcctccatattcctacttcaacagcatttttagttgctaaatctgataacttggataataaagatgagattcgatagtttccttgataatcagcttcttgacattcaattgttaaatcgcaataagaaacaatattctccataatatctccttttttttatactaaaatataaatatcagtatataataactatataataaaacaaattaaaactattgtatagaggtaatcatatgaagaagatcaataaaaagagggtagcctttgcatcactggtaataatctgcttaatcataataatcgcacttattatcaatttaactatcttaccattatttaataattcaaacggtgttacaaaaaataagcaagctaaagcaaaaaaagaaagctatgatactgtatctctggttgctgttggtgataatattattcatgagcgtgtttttcaatatgccagcactaacggtacatatgactttaccccttgctataaacatataaaaaaatatattcaagatgctgatcttgcttttattaatcaagaaacaattttaggtggtgataccttaaaaattacaggatatccggcttttaattcaccaagtgaattagctaaaaatttaattgacactgggtttaatatgatcaatggtgctactaatcattctttcgaccgtgattttgaaggtgttaaagcggcttctcagacttggcgccaatatcaagatattatttatactggtacatacgatagccaaagtgatcgtgatacaattaggatcattgaaaaaaacggtatcaaatttgcacttttatcttatacccaaagtctcaatgaatataatactaatccttataagttgttaaaacaaactgcctatgctgtacccttattggaggatacagcagcaatcaaagcagatgttcaaaaagccaaagaacaagcagacgtaataatcgtctctgcccattggggtgatgaaaatgaggcggaagtaactgctaaacaacaagagtatgctcaattatttgctgatttaggagttgatttagtaatcggaactcatcctcatatcattcaacctgttacatgggtgaatggccaaagtgggaataaaacactcattgcttacagtttaggaaattttttaagtacaatggaaactcaagatacacaattagaagggatgttatcattaaactttattaaaaaagatgctaaaatttttatagatgacattacctggacaccactaatcaatcatttcggtgataatactgttgaagtttatcctcttgcaaaatatccagatgataaattagctaaacattttgttttacatgataaacctaacattattcagcaatacaaagccaaaacaagagatgttattggtgataaaataactataaaggactaaatccatgaataaaaaacgcttaaataaaaagaaagtattattagtttttattccccttattattgccggtactataatctactggttcttgcctagtaattcaaccaaaacagaagaaaagcaaccgaaaaaaacagttaataacgatccccaatattatcaaacttcgttaaaagaacgttatgaaaactatcaaaaaactaatcccgatctttcgacagaagaaataattacccgagttaacatgaatcttgattatcctttctatgaagtaatcattcctcaaaataagccattagaattaaatacaatcgtaaataaatattataaattagatgataacttcactcccgacgatcttatttacatcaatgatacttatgccaatacaagtgatcctgcctataaatatcgaaaacatcagatgcgaaaagttgtttatgatgattttattgcattaaaagaagcatgtaaaactaaaggctttaatctatacgtcgttagtggctatcgttcgacaacctggcaaaccgaaatctataatcatatggtgaatacatacagcgttgctaaagctgaccaaacttgtagccgccccggtcatagcgaacatacgaccggtctagcttgtgatattgcacttgataattacagttttgaagacgttataaagcatccccaatatcagtggtttcttggacaactagctaactacggctttattattcgctatccagaaaacaaagatacacttaccggatatagctacgaatcttggcatcttcgctatttaggaaaagatttagctaaaaaagtgactgctagtaatttaacatatgatgaatattacgcacaaaattatgcaaaatagcctgtttcagtactcaggctattattttttcactaaaatttatgatgattattaaacttttatcaatttttatataggctaattcatgattttctagtataatagagatattgaaagaaggagtatgactaatggatattattacaaatgtattaccttttttggtatttttagccttattatggtttacatacacaaatatttctttagcagtagcaatgtatcgcgcaaaaaaagatgatagtaccctatcatcatgtctaagcaatactggtaaatatttttacattggcctaacaattttctatattgccttatttgtggggagcgttgctttaatggtattagcgctaatcaacaataaattagacgacctatatttaccactaaatgtcttaacgatcggaacactagcgattggttttcttttacagcaaatcatcttagttgggcaccgtcaaatgatgatcggtaagatcaaactggattatcgtaaaattaaacgtgtttcatatccaaaagcaaaaaaattaagatttgtttatggacaaagaacctatgaaactccacttcgttttatcgatgatttcaaactaaaaaaagctttacaaaaagctcgttaaactcttatgggtagcaaaaaatgctacccttttagtttacaatttaatttgcattgatatccttgcaattcgattataaaatttctcaaaagaatcgttccctttaaaaatatgattaattatcttcccatcctcaacataatacatttctgatgcatatgatgcaaccaagcaatcatgagtaaccataacaatcgtaataccatatttacgattaatctctgtaaaatactccattaattgcttagccctaatactgtctacgttccctgtcggctcatcagcaaaaagaatttttggcttacatacaagtgcacgagcaattgcaattcgctgctgttgaccccctgaacattcaaaagggtatttatctaaaagttcttcaatacctaaactgctaattatttgcttgatttctgcttcattgataatattctttttattaagttttaaagaaaataaaatattgtcaattacttttaaagaatctatcaaattataatcttgaaaaataaatcccatatatctctttctaatatttgctttttctttatccgacaacccaactatattctgatcaaagattaataattttcctgaagtagcctcatcaattgttgatagaatatttatcaatgttgttttaccagaacctgaagtccccataatacatgcaaaagtccccttatttactgaaattgaaactccatttaatgccgttttaggatatggtgtatctaagccatacactttttttaaattagccgctttaattatttcttccattttcttatcctcatttcctcttgatatacagcaactcgatatgaaataaacaatggaataataagctctaatataagaaataatgcagacaaaactcccattttatcacgatagacaaaagcaatatttaaatttgataaatataccaatgataagaccgcaatcatttcatacatcaatgttttttctttttttgtcatatatctgatttcttcataattaagacctaatcgacttaaattacgataatattgctttttattaatttgattaattctaaaacgattaatcaatgtaaagcttaaaacaatatttgttagcacataccccaattgaaataagatcatatactgtaaatcatcaagattagtacacatcattgttaataaaattgcagaagataatacaaacattaaaataactgatttcatctgctgcagattcaaaataaagttattaaaaattagactttctttagcatcaatattctttaatttaatccacttttctaataagttaggaaaacacataatacctaaattatatgctcctattacatataaaccggctggaaaaatcaatccctgatttaaatcactgatgtagatagtaaaagtacctataataaataatacaatataattaacgttagctactatcgttattcgccttcttttcttaaacgagacgatttcatcatttttaagtaaatcaggaataactccgcggatagaatacgatatttgcataaaagtcataaaaactaatagaagcagtaccaagggcaaagaatcgacatatgtttctaaagcataataaaagatattttcactaacccccatataaagataagcaagtgcctgacataatggaatcagcaaaaaactaattcccacagcaattaaataactaattaaagtgatcacaatcaactgaatcatctggaaaaataaaatttctcgatcacgacaccccattattttcaatagaccaacaatccgtgaatttgttttattatagtaattacaagaatacattattaatgaaataaaaatcactaataaaataatgaccattgtccctttatacattccatcataaaatcgcatcacttcgtattcagtaattgcttcataaccataaaactttgttgtatcttttaaaatatttactaaatagttaattatgggattattaaagaattggagaaaaataatacatacacataaagttattgtaattgtaattccaagatttaaagctttttttcgctctttccatagcatctgtaaagaaatctgcagcatcccaatccctccttttttattaaaaagatgctttaataatatccttttcttcctttactctaaactattgtctaagcgtatagtcaatgtttttaaataaaaaacgattaaaaccgtacactatttttagtgtacgattttaatcacttcgtttacttaattctttttgttcacattcttttatatcatcaccaattaacttatgacgataatatctagatttctttttgacctcttggttaatctttctataaccatattgttcaatcaaagttttctcaccagaaaaaagattaactcctaaacctaatttgtttccatctatttttacccccattgctgctaaaatagtaggatacatatcaataattgaaaattttcggtttttattaaattttgtagtaactgcactattaataaagcagttgtatggtgtccgaacataatcgtgatcaagattagtaaaaaacttttctgacatactattatgatcaccagtaataactatagttgtattttcataccatggctggctcttgcaccaatttataaaattattcacttgttttgattgacaggcaattacgtttgcatattggcttttatatttatgctgacaatcttcacatacatacccatcaggtgtatgcgtatcaatcgtgactagctccatattaaaaggtttaccacttttagccaatttagtaatatccgctttagcaaactcaaataactttttatcttcataaccccaaaaaacaaaataatctttagcaattcttccttcctcaactgcggtattgtaatcggaaatataatagttaccatgttgtttataaaaatttgatgtacacccaaaattactatcagaacccatcatgatttcatttatataaccatgctgttccaaaatttcaccaagtgtataaacaccactaaaaaaattcgatttatcattatatgattttgaattaaatggtactaacagcggaattcctgcttcttggccaaccattgaagcaatcgtccactgtgttccctctaaggtcaaacttccaccgatttggttatgatgagaaaagttaatattttgattcgctaatgcatcaagttcaggcatataagaaacatcttgaccaccacccgatgtttttgctaaataagcattttcgatagattctaaatagatatgaataatatttcgtttacagcttggaaaagttaacgttacccctttgggatcaacataatgttcttcatataattgtgtttttctaagcatatcaaaaacatatccaaaaatttgataattatacaaagcaaagagcaaagaaccaataattgcaaaacaaccaattgcaaatatatgcgctattaaatatatatgaaatgctggtaaaggtagattaaaaacgattatttctgtgaatgcaacaattacaaaactctgaggaactgtatgaagaaaccagtcagtataaattccatcatctgtaccatccataggaacttttaaatgaaaaatcatttgatttaatgtcttcacagaaaaagttcgatttccccaaataattgaggctacgatcaaaactgcaataaatatcatcaatgatccaatcacttctttaaatgtaattaactgtattattctttctatcatcacaaccatctttcttcttattatttctatttattctagcatataaatagacctaaaacaaaaatttcattcaccaaactttaccatatttttacatttaccttactcttcttatgtgaattttaaattaataaagtatatttttattagataataataaaatgactaatactatatttattttacaagagtaagcttaaattcttgataatgcttagaatcgactccgatacaaattgaaacatcacctggttcaacaagatatttcatttcataattccaaatagcaaaagcatctgaagttaaatgaatacttatctgttttgattgataggcttgaatttttactttattaaaagccttaagttcaattactctagaaacaactgaagcctgatgatcctttaaataaacttgtattacatcttcaccatcataggtactgttattgtatatttctaactgcaaatcaattccattttcaagtaaatcggttattttaatggctttaggtaccttgatatctcgataaataaattgtgaataacttaagccataaccaaaaggtaacagcgcttcaccgggcatgtcaacataatctttttgtgctccattatgtttatgattgtaataacaaggtaattgtcctacatgttgcggtatagaaacacttaaatgcccacttggattataatctccaaacaagacatcagcaattccctcaccgcctctactaccaggataaaaacttgctaaaactgcttgagaatgctttagaaccgtatttatgacgtgtggcctgccttgaatcaatactgttactatgtgtggattcacttctttcaaagctaataaaagctcgttttgataaccttctagttctaatgaagctaaatcaatgttttccccacaattcatttggttttcttgatttgcttttaccgcaccattgttttcaaaggtatcttgatataatcttgtgctattaccgcctaatactaaaataacaatgtccgccgctttagctgccacgagtgcgggctcaatatcgaattttcttccccgtattgaacatccctgtacatagataggggaaatttctgttttttggcaaataccatcgtacactgtaacaatatcacttttgttttgataagcagtatagtctccaagttgatttaagtagtggttagcatttggaccaataacagcaattttttgttttgaggataatggaagaagtgaatcattatttttcaataatacttgacattcccgagcggcctgaagtaataaatctgatgcttctggtaatgaataagtatttagttcttcccataatcctaattcttcttttaatctcaatacccttaatactgcttgatcaagttcctcttcagttaaataaccttgttttattgcttcatctaatcgtaaataaacattatcccataaactcagatctactcccgctttaagtgctaaactgccaacttttaagatatcatcatccaacaacaataatctatctaaagcacatccgtcagccataacaataccagaaaaatcatattcttttctaagggtttcaaaaagcaatgctttattaatatgacaaggaattccatctatttcattatatgcagccataactgccttagcgccagcatcaatcgctgctttaactggtggtaaatgaatttctcgcaactcccgaggtccaattaatgcagcatctgaattatgtccacctacacaacccccttgcgcacataaatgtttgacaactacagctacaccgttcttttctttttggaatccatgtactgctgcacttgtcatacagcttgttaagtaagcatcctcactaaaacattcctcactacggccccatctaggatctcttaaaacatcaaatcccgtaaataatgccaaatttccacctttggcagcaagttcctggctcacattatgcgtaattctttccatcaaatcaggattccaagtcatccccattgctaaattagttgggaataccggtgcccctaatgccatatgtccgtgcacacattcttcgctaattaatgctgggatttcaaaacgtgaatgtttttttatatattcttgaatcattgtaatgacaattttactatcttcacgactaattccattttctctattgatctgagaccaggcatcagcacgtaaaatgccataaattgctccaacgccaccatattccttaacatgttctttaaataagtctgttaattcatattttccattaactttttgataacattgccatccatataaatgttgatttaattgaccaactttctctttcaacgtcatctcttttacaattttttcaatcatctctattttctcatttcttataaatattttttattatataagtattgattcattaattctcttaataaatattctattgctaaatggatatgcaaacgtgaatcaatatcatatccttcatccttagttacagaaacattcatcacataatttgacagtttcgtcattggggaatttctcgtttctgtaaccaataatattttacaaccactaagtttggcatttttcattacatcgataattgcctcagtagcaccacctcttgatagcacaattacaaagtcatcctgagtcaaattattagcttctaagtataaaaaccagtgatcatcaggataaatcgttctaattccatataaactcaacttcactgctaatatctttgcaacatatttgttcattcctgaagaacagattaaaacacttttagctttaacaatatccttaatgacatcatcaatatctagattgcgtaacatctcaatcgtatctttaatttctttttccaaggaatcacatgtactctcaactggagattgatactcatattcgtctcgacgatgatataaaagatcatatctaaagtccataaatgttttataatccaatttctttaccatcctaaaaatagtcgttgtagatacatttaatgtttctgctaaagaagaaatcgtcaaacttggttctaaatcccgaaacgttaataatttattaaaacattcaatttctaattctgttaaattatttccatatttttgaaaattcttaattaaactcatatgcattacccttcctatatgaaaatagagtagaaaaaatctactctattataacagtaacgaaagtatttgacacaatatttttgatgattacctttccattttgattttcaacttctgtttgtttattttcttgaacatcacataaataacatcgtttattaataggaatgaaaagctcaacatctgcgacatctacttcacgattatttaaaatccggaagatagaagcttcactattttcagcttttttcaaagccataaattccactcgttcatccaacgtaatcgcactataagaccaatcaagttttaaattttcacgtctacttatatcattaagatagcgtgtttgaactggtgtatttattacttctgctgtttgaatcatcttactcatctgttctttcgttccaaaaaacaatgaatattcacttgttatagtttgatttaataattgtgaagatggtgcatccatacgatatcctgaagaacgtccaggtctaatcaatagatccgctttaccaaattttcctacacttcttaataaggttaaacaaattttttgattattttcaatttcatattccaatggtcctttacttaatactgccataattgatttttgatgatctagtttaacaaaacgctgcattgcatatattggcagaacatactcagtggcaccatcttttaaactcttttgattttttattacgttttgacggataattgttccaaattgatcttgactacagttttctgctgctttataaatatcttcaaaacatactcttacgatatgatcacatgaatgattattaattttagttacgaaatctattgtttgactgtttgccttcaaagagacatcgctacatattttaaggggttttaatgcttgtacacgatggtgatcaactactttttcaggaacttgaatttgatattcaagccgatactttacttcaatagaagatgattcaatacaagtaatcattggatgaatatcattaattcttatttctgtatcatctatacatggagaataattatattcatcaccatcatcccccttttcgacaaaagtatttaactgatgatatgtttcctgagtctgtttattcgtaacagaaagcgttccatcttcttgaatgtgcatcactaaatacttattttcagcaccattttttaaaatgacaacatctccttctggtctttttgaagttctttcatggaaacacacttttaaaacttcatagcccattggtggtaagaaagatgccgcaatcttaatttgtactttaaattttgttccttctaaaacttctcctgcatcatgaaaattttccattccattataatattcaatatcatggctagttgctttaacttcattcattatttcataagggacgattgttccatcttgacgttttaacacaaagttcttatctttaacaatcatgcttgtaaaagcataatcattacgctgataaggaagagtattaaatagaactaagatgtcctcattttcctttagtacactcaaatccactgattctgccaaataacggaaattcatccagattagctcatttaaaccatgtcttaaatttaataaacgattttctacagtatggttaatactatctggtgaagaaccatagatagaatcatgaaattgattcttaaaaataatcttccaaaaataattaattaattcttgatcacaatagcctccttgaaaacgcgagatactaatcattggttcaattacttttgccatcattgtttcataatgacgcattgcattttttatatcaattctagttgaggtgataccagcgtgaattcgacctagtgcagcacttcttgcttcaccttgataaatttttaattgatgatgatttttctttgctgcattaagcagtgtatcaagataatcctcagggttattcataatacagtcataaccatctttttgcaattgttcaattgtctttgaagaatgtttccgtggaaaagcatagtcactccccagcataaataaaacttcttgatcttgataacgagcttctaatttaggaataaaatctgtcatatctttttttacttcttcataatcctctggaaatcctcggtaatgcccatatcccaaagcaaaatgaacagttggcagcgatgcatcaccatttccttgccacataaataatgaatcatctaaaacatcataatcaaaaccacgccaagcaaatatccctttcataccaatttctttaaatagataaggagttatcttattttgcccaaatgcatccgggacccagccaacattcatacaatgacctaatcccgcagcatatttagaaccaactaataagtttcttaacagcgcctcacccgagggaataatcatatctggttgaacataccatggtccaataaataattttcgattctttactaattgcgaaatcctatctttttgaaatggtttaatcgctaaataatcttctaacgctgctgtttgtccatcaaatgtaaaatatttcatttgtggatcattctctaacatttcaatcagtcgatcataaaaatagactaatttaattcttgatgaatccgttgaacgtaaccactctctatcccaatgaacatggggaataaaatgtatcttactcaacggcagcaccttcattctgtgcttctaaagtattttgcttgatttgtaattttacaaacggataatataaaactaaatctaaaataaataatactatacataaaataactggactcaatgtaaatgcccccaatacccaagcattaacaaagattggttccaccccagaattcaatacaaccaaatggttaactaatccccatgatgttgcaaaatatccaataattgcattaataactggtacaaatacaaatggaataaacataattggatttaatacaatcggtaatccgaatgttacaggttcattaatcccaaataaaccaggaataattgaaacctttccaatcgatctctcagcagaaccttttttccctaatactaataataatacaactaatgctagagtagagccagaaccaccaatcattgcatagacattacataaagtatttggtgctacttgtgtaattttatcaaaagaacctgtttcaacaaaaatttgaatatgttcatagaaaattggcatccacaatacagaaattaatccccacataattgaaaaaccatgaactccaaagaaccataataattgcataattataattactaaaataactgctggtaaacctgtaccaatcccatttagtggagtaataataaattgagtaatcaattgttggattgaatcaaatcctgctaaaacaacaatttcctttatcactgaaaatacagtaatgataacaaagaatggaataattgataagaatgaacttaataccattggcggtacttgtccgggtaatttaattgtaaattttgaattaactagtttatagtacatatatgatgaagccaatccaataatcattcccgcaaacattccttcataattaaagaagttgatttgaaaagctgtaattgtactatcacctacattaatagcattaggaatagttgctatataagcaatcaaagaaacaatacaagcaactaatggaacacatttatctcctttatttagcccttttaattgattagcataattgtatgaagaagcaataacaacaactaatccagttaaacccatagccacagtattaatatttgtaaaggcattgataatacttcctaaaataccatccaatgggattccccattctccaaaccaataatttgcctgctgacttactagacctgccaacgaacctaccacggtaaaaggacttgtaagaatacaagcatctttaattgcattaagcaatttgtttgatgtaattttattagaaaatggcattaaatacttttctaataatgacataattaatttcattttatttcctccctctttcatataaaagtatatacaaagcgcttccataagagaattacagaacttgtaaaatttttcctaatcaaaaaacaaaaaaagaagatcgaaatcttcttatcatttttctattttatcatagatattatttattcaaaataagttttgattacaagctccgcaaataaagaatcagcccagcagaaccatggtcttgtaaactgagtatcatcatttacatcaaaactttcatgacaatatccagtacctccggtattatcaataatagtctggatcaaagcttctctttcatgctgtaataaacttgttaatccttgcatagatagcgcaatcggccatatatattcagaccaggtatgtggcgatccaattccctttgccctgttcccctcaaaataatatggattctctttacttaaaataaacgctcgtgtatttttgtaaatttcatcattagcatccgcaaatcctaaatatggaattgacaataaacttggtacattggcatcatccattaatacatgattcccataaccgtctgtttcataggcatatattttcccatatttagggtgtctaacaataccgaataattcaataccataatcaatttgaaatttcaaatcaacaattcgctcttgaagatattcatcctgatacactaattccacaatttccttgagatatcccagaacaacactgcaaaacatattgccaggaatattataattaaaagtacatgcatcatcacttggcctaaatgcgctccaaatcattccggtataacgtgtttcaaaaccacgtcctttattttggagggtttcggtttttcttaaattccatttttttgcttcttctcgttcaaacgtatatgatgaattttgactatgattttgttcacattcaaaaacatttaaaagagttctaataaaatgtaaatactgttgattaaaaatacttttatcaccagtttctttataatattgataacttaattttaccggataacataatgaatccaattcatactttcgctcccagacatacggtttcataatagtcgtatcatgatattccctttcaacatcttctgtatttaaaaatgcatttgcataaggatcccacaaaacatattcaacttgagctttaattaatcctttgattattgactgtaattcactatcattatgaatatattttaaataatgattaacttgacagcttgaatcacgtaaccacattgcattaatatctccggtaataatataagtcttatcaccttctcgtttaacacttgtttctagcgtagacaaaaagcaccgtttaaacatttcgcgtaacttttcatctttcaatactgtatcagcttgttccaataattccttaatcgtcataatgctttcctcctgtttcaatcatagctatctttccttaaattgtctattcccaatactgtatattttttacaagattaagcaaataaaaaccacgcctaaaagacgtggttttctctgaggctataagcctatgttgcttgctcgcgtctcaaggcgctgctttctcttcgttcaagctatcgcttttgactctcgccatccctcaaagggatttatttcctcctttctccttttgttatcttcttctctcttttttgttttctttcttcatttctttatcttcaaatggattttgatattcttttacactcaatttatccattgctatatcatgtccctcttgttcccttatatattttgcgactgtttgatcatttagtcctactgtactcacataatatccttctgaccaaaaatgtctatttccatatttatatttcaaatttgcatgtcgatcaaatatcattaatgctgacttacctttcaaataccccataaatgatgatacacttaactttggtggtatcattaccaacatgtgtacatgatctgacatcaaatgcccctctataatttccacccctctatattgacataatcttattattatttctcttatatcatttctaagttgattatatatcacttttcgtctatactttggtgtgaagacgatgtgatatttacacatccacttcgtatgtgccaatgaatttgttttttgtgccatacttaatcacctttcctttcttataatgacagcttgaacaactccattatatcggaaaggtgatatctttgtataacttctttattgctccacccgcatagcaggtggttttttatttcgcatacttcgtatgctcaactgacttaagtctatatgttcaaattttcaatttgaacaggtaacaaaaaaattggcactaaaagtgccaatatatatctaagacattatctagttcatcttctaataaatcatcatcatccatactactcaattatcttctttaattttttttcaaattcacggcgtgggaacattacaatcgctccgcatcccaaacatttaattttaatatctgcacccattctaataatttgccattgtgttgactttttgcatggatgagccttcttcatttcaacaatatcatttaatttatattccatattagtcaccatttctatgataaaaagcttcaattgtatttttcattaacattgtaatcgtcattggtccaattccccctggaactggagtaattgctgacactttgtctttaacatcatcaaaatcaacatcaccgcataatttgttattttcatcacgattaattcctacatctaatactactgcaccatctttaacatactcgtgattaaagaatttcggtttccctattgctgcaataagtacatcagcacgtgaacaaactgcctttaaatcttttgtctgactatgtgcaattgtaacagttgcatttttttgtaagcacaataaggctaccggcttaccaacaatattactgcgcccaacaattactacttctttacccgccaaatcataattaatttcttctaataaaaccatcatcccttttggtgtacaaggaaccaaactatgttgtcctaaaaataatttagccacattttcgggatgaaaaccatcaacatctttactaggaacaatcgcatctaaaactttttcttcattaatatgctgtggcaatggtaattgcactaaaattccatcaacagtatcatcattatttaaatcattaatttcttgtaataattcgatttcactaaaagatgcatcatgtctcaagatttctgattcaatcccaatatactgacaacctctttctttgttcctaacatatgtctgactagcttgattatcccctactagtattacaaccaacttaggtagacgtggatatgtttcttttatcttacttacttcttcctttaattgatcctttatttttacagatatttctttaccactaataatcactactcaaatccccctttaattattatttcaattataccaaaatataaacttgttgcaactcttagtccaactgatctaaatattcttgatactctttcaaaataatttcaagttcttcaaaagtattaatcttagataattcatttttcacacgagctgaagactttaatcccttgatataccatggcgcatggccacgcatttgaaacatagcaaccttttctggttcaatttccattaaacgtcgtgcgtgtgctaaacactgcgtaattttttcttgataagtaggttcactaattgtttcaccagtttttaaagactctacaacctgtttaatcaaccatggatttcctaaggccgcacgaccaatcataactgcatcaacttttgtttcttcaagcattcttttagcatcctcaacactcttgatatcgccattgccaattactgggattttcacagcttctttgacttgacgaattatttcccaatcagcatgaccttcatacatttgcgaacgagttctaccatgaattgcaatagcactagcaccagccttctcaattagttgagcaacctcaattgcattaatatgttctttatcaaaaccactacgtatttttactgtaacaggtttagttacattatcaacgacacctttaacaatctcataaattttatcaggatataataataatttactaccagcatcggcctttaaaaccttatttactggacatcccatattaatatcaataatgtcacaattagcatgtttatcgatatatttggctgcttgaaccattgtttctacttcaccgccaaatagctgaatactaactggatgttcgccatcatctacttgtaacatttctattgttttagcatttccataacatagcgctttatcactaaccatttccgaatagacaagtccggcaccaaaatctttaataattttacgaaaagccatattagtaatccctgccattggtgccattactactggattttctatttctacatttcctattttaaacattatgtcactcctcaaaagtatcttatcaataaattaaaaaaaaagaaatataaatgtataaaatatttcttcatagccatactatttatagataacttacccttccccgctattttcctccccgaaatagacgtaagttatcgagttagttatattcctaaatatgttggtttccaacaaaaaaagaaaggcttcccccgcctttctttttatttttctttacaagtaagtccacctttttcttgttctttaattgtttcttctaaagaaatatacacgattttcttatcactatcagtagttgtaactaatttagcttttttaagttcatcaaaatcagcttcaccataatctaattcaattttaagaataattttttcaccatctacagtatatttagctgaaccaccttttaatgaatcataatcaacattaatagatttcactttaggaagccaataagtatcaattggtgtactttcagttacataaccagtaaaatcataagtaactgtacttttcatgacatcagttttatcaccagttgcttcgatcgtaacttcagctgctgtcatttcatcaatatttcctttacaaatagtagtggttttttcttctccaccacatcctgttaatagcaatgccagtaacattacacttaatagttttttcatttgattttccctcactttatttgtctataccattatcatagcacaaaatttacctaaaaaataccataatagtacatttgtagcaaaataatcacataaaattacaaaaaatagaatagttttcactattctactataatctatttttaatttcttttaattcttcttcactaaattgatattttttattacaaaactggcaacttaattcacaaccatgatcctcatcaatcatcgcttgtaactcatccttaccaactgtaatcaaagccttacccattttctcttttgaacaatcacatttgaaaaacaaatcttgtttttcagtaatctccacatcatcaaatagctgctttaatatctcttcaggacttttcccttcattgatcaacttagataccggcggacattgagcgacaactttttcgatataatcaatatcttcttcaatagcctcaggtaataattgaataataaatccacctgaagcaagcacttcattagtatcatttactagtaccccaaccgatacaactgaaggagtttgttcactaactgcaaagtagtaaccaaaatcatcacctatttccccagtttgtagtggaactgatcccgtaaacggttcttttaaacccatatcacgaattacttgtaaagttccttcatgtccaactgctacaccaactgctaatttaccagtatcattataagtataatgcacttctgggttagcaacgaatcctttaatatttccatcaccattagtaaccgtcatcatagttccaattggaccgccaccattgatcacaactgtcattttctcttgattcttgttcatttttgccatcatcaaagtagctgacatcattctcccgattgctgcagaagcagtaggccataaattatgatgtttgcgagcctcatctactaaattagtcgttttacaagcaaaaacgcgacagtttttactattaactaaacctctaactaaataatctttcatatattctccttataaaaataccatcaatgatgataatatcattggtattatcatacacaaaataataaaatagataaatatttttcttttcttgttgttcatcatttacctcacatatgaaaaaaagcggataccgcttttatttcatatcatctaatagatcatcagcatcatcaaacgatggtgttgttgtacttgaagcattagaatcatttgatgaatcatcattagagctactatcaactgttccatcatgacgatctaacatcttacctgtattaaataatgcttcaatttgttcaccagctaatgtttcatattctaataaagcatcagcaataattactaatttatctttattagcctcaataatttcttttgcctgtgcatagcattcatcgatgatcttacgaacttgaacatcaatttcataagcaatttgcccagaatgagaattattgtgttgtgtatagtcgcgtcccaagaaaacatttccttgttcagaatcatatttgattggaccaagttctgacattcccaattcagtaaccatcattcttgcaattctagttgcttgttcaatatcgttatgagcaccggaacttacatcaccaaagaaaatttcttcagctacacgaccacccataaatccagcaatattagcttctaattgagtcttagtttggaaatatgtttcttctttaggcgtcattaagttataacccccagcttggccacgtggcacaatagttactttttgaactttgttggcagcttctaaagttaaacctaacacagcatgtccagcttcatggtatgcaactagacggcgttctttttcactatatttacgagattttttcgcaggtccacccataacacggtcaactgcttcatcaatatcatccattgagattactttgtgatcttcacgaactgctaataaagcagcttcatttaaaacattttctagttcagcccctgagaatccaggagttctttgtgctatattactaaaatctacatcgggagcaaattttttgttccgcgcatgaacttttaagatttcagtacgagcattcttatcaggattagctacctgaatttgacggtcaaaacgacctggtcgtaataatgctggatctaatacatcagcacggtttgttgccgctaaaatgatgatcccttcattaccactaaatccatccatctcaactaacaattggttaagagtttgttcacgttcatcgtgtccaccacccataccagtacctctttgacgcccaacagcatcaatttcatcgataaagataatacatggcgcagtttgtttagcctttttgaacatatcacgaacacgaccagcaccgacaccaacgaacatttctacgaattctgaaccagaaattgaataataaggcacactagcctcaccagaaacggctcttgctaataaagttttaccagtacctggtggccccacaagtaataccccttttggaatacgagcccccatttgagcgaactttttcggatttttcaagaatgctactaattcttttaattcctctttttcttcatcagcaccagctacgtcagcaaatctagttgtttggtttttttctaacttagctctagagttaccaaaatcaaaggctttagcatttccgccaccttgacccatcatcttgaagataaagaacattcctccaagtaataatacatatggtaaaatactaataatgaccttcataaatacaccacgatcattagcatcaacaatcgtagtttcaatacccttttcatttaacaatccagttaatgattgcatttcagcttcagtattaggaatcgtagttgtaaattcatactctgttgatttaccatctactttctttgtatacttcccacttacatcaacgactaaacttgaaggaacaatttctacttccttaattttttcgtcttggactacttccacgaattcactatacttaatctctttactattaccctgattcatataggtaacaagtccaccgattaagaataatagaactacccatggaagaatcgattttaataatccattcttattactcatatactctccttacttataacaatcttcttttaatattccaacatatggcaattgacgatatctttcattaaagtcaagtccatagcctactacaaaagcattagggattttaaatcccacataatcggccttcatttcaaaaacccgaccctcttctttatctaacatagtgacaattttaacactattggctttacgttttaatagcatctctttaacattaaataacgtctttccagtatctaaaatatcttcaacgatcaagacatttttaccactgacatcttcctttaaatcttgcttaacaactaatgtcttggattcaacaccctcataactacttacattcatatagtcgaaagtaacatcagtatttaaatattttgataactccgccataaaagggactgaaccttttaataaaccaactaataggacttctttcccctcatagtctttatcaatgattgcccctaattctttacatttagcactaatttgatctccactgatcaaaatttcttttatatccttatgcattatctcactcctagtcgtatatgtttctaattttaccacatatatattgggttttgaatataaatacccaatattttttgcaagatgtggcacaagaattatcattccttggctattttcaacaattggccaagtatcccgcttacttttaggaattttattgtcaataaacaatcgcgaaaccttttttgttccaccagcagtaacaataacatcaccaggacgtgccgatctaatcgtaattgggaaatcttctttactcacatagacgccttcatttaaatgacctacttcacttaaataaaagtgctcatgcttatcataaactaaatgttcatattttaaacaatagctatggttatttttcaaattagaaacacatatattatcatactcttttatgaacctaatattaacaggcaaatccatattaatatttggcttattactttttatttgtttaataatttctttaatcaaagcattgctgatcaaagggggataaacaacttcttttaaaatttcataaataaatccatctaacagctctttaggaatacaagtataatcaattttatttttttgatgatataaatcaagataaatttgtaattgttttagcttactagcatatctttgattatgttcttgtgcccacttaagtaatttctctattttttcttcatcataatctttcaaagtaacatttcgaacataatcacgagtaaactcagtttgaaaatttgtataatcatcacgatattcaacattatgaccatgacaatagtctcttaaaaactgttttcgtaccgctaagcacggtctaattacagttactccaaatacttcactgatttcttggattcccagatatcccttagtgttatggcgctgtaactgcattacaatattttcaataacatcattttgatggtgggccaaaaccactttttgggtttgatatttcattccaatttctaaataaaattgatagcgtagccgccgagcttgatcttggaaattatccggtccgtaaacttgtttatcaatttctcgaacataacaaggcaaatcatatcggtgacaatatgcttcaactgtctgttgatctaggtcactatcttcgcgtaaatgataattgacgtgacatacgattatttggtaaccagcttgattcatcatgtctaataatgccatcgaatcacagccccctgataccccaaggatatacagctcctgcattttcagcaaatctttaaaactatccatttaatcacctcaatatctttaccattatatcaaataattattaatttaacatatcattttcgtgactttttcactaatcaattagtaaaagacgtcatttttaaggacgccttcttttaaaattacttctttttgtcttactattcttttttatgttatttgttcttactgatgactttttttgtccttgtttcaagtgcttagctttatcacgtgatttttgtgtttcacccttttttttacttttatgtttcttttctggtattgataaatctttcattgggtaataagggttatccaccaccggaatatcttggttaataaatttttgaatatcttttaataatgccttttcttgaaaactacaaaatgtaattgcttctcccgatgctccagcacgagcagttcggccgatccgatgaacataattttctgcttgatcaggtaaatcaaaattaataacatgtgttaattcatcaatatcgatccctcgagcagcaatatcactagcaacaagaactcgaactttatcatttttgaagttatttaatgctcgaacacgtgcattttgagatttatcaccatggattccctcacaagttatttgcgccttaattagtttcttacataaagtatccacatttctttttgtcctaacaaaaacaattgcattatatatttgaggattttctaataacttgatcaataacttagctttatttactttatcaacaaagtatagcgattgattaattttttctactgtaacattaccactgcttatcatgattttaagcgggtcattcagtagatcactaaccaggtgtttaatttcatcaggtaaggttgctgaaaataacatagtttgatgacgacgaggaataaatcttaagatcttacgaatatctttaataaatcccatatccaacatacgatctgcttcatctaaaactaagtattctacatgttttaaatccaccaatccttgattataaagatcaatcagtcttcctggcgtggcaatcagcacgtcgatcccacgattaattttagtaacctgactaccctgacgaaccccaccaaagataactgctgattttaaattaacctgcggattcattgcctcaaaagtctcattgatttgaattgctaattcacgagtcggagccaaaatcagtgctttaatagttcgtggatacttttcgctttcatcacgtaaatataatttttgtaaaatcggtaaagcaaaagctgctgttttccctgttccagtcttggcacatccaaaaatatctcttcccgaaataattgctggaattgcctgttcttgaatcggtgaggggatatcatatttcatttcttttactgcatttaataatggttcaattaattctaattcactaaatttcatctatttctctctcttaatcgttttttgcagtataacacatttattctaaaataactaattttattcacaattccataaattaacctcatctaatagaaatttcagctaaattctcactatctttttatactttttgaaatatagatattttaaaattttgctttaataatactaaaaatagcctttattatttagcagtgtattaccatgaaaatagaaaaagaaacagagaattagcttaaacagtaaaaaatattcaaacaaaataaaagtcgttatggagtgtgtagggtctatcgagaacttcttaactgtgcttaccagataaatcataaacgtgtccatcacattatgtacaacttaggattattcagtaagattgttgacaataccatagatagaaattttggtacaactgatgtttcctagtttaattttttttgaaaattaaagaataaaatgtattatgaaaatgaatttaaatgttttgaagaatttgcagttgttatagatgaatatatagatcattacaacaaccaaagaattcaagaaaaacaaaacggatatctcctgtaagatacaaggaaacatccatatgtattgcctagttcataaataaacatgtccaaaattatgggtacatatcgctgattcattcaaactaatgaagtccactaaattaattatttaccactttaataactataatacttatatcatctaaattatttttctctaatacttgatccattaaaaaagtagctatttcttgtgggtgctgatcacaatataagtgaacattatcattaacgatctgttcaaaatcatttcctgttccatcacttgacataataattaaatcattattttttagcggcatctcataactaaccatttttaatttagaaacaactccaactggtaatgaattagttgcaattttttcaaccattccactacgaatatgataacttggattagcaccatatttgattaacttcattcgggcattagcaagattaatattacatagatctaaagtcgtaaacatgtcgttacgattttttatttttaataaagcattaattgaatcaattgtatcttttaatccaattccatttaaaattaattttgatagtacttctaatgtcaacttactttcattagcagccatcttgccttgacccattccatcactcaatgctaaataatgaagattatcttgatggaacgcgctaaacgaatcaccacaattaagaggctctaaagcatattgctgaaaaccatactgcaatgaataattttgttgatgttttaaaactaatgacgtgtaaccaagatgatgcattgaatcctttagagaaactatttctaatgtttcatttaaatatgactctactattggaactagttcattaacaacctcctcctcactaatatccattaatcctaattctaaagtataaacattattaccgatttgatgacggtataaatatgtaatattaaattgatagcctaataaatgctcttttaaactatcatcatttaatggcgtttgttctaaagaattgctaaaattatcaaacacctcactcaataacgaaaattcataaaacaaatctttctttaaatgcgaattttcctgattaactctttttatcttttcataactatccttatattcactgatactctttaagaagcgatttggactaatgcaattactattaatatagttaatatcttcttttgtgtagttagtcttaaatcctttattaatcaattttcctaatcgacttacactcccatcacgataaaaacataaatcccgactaggacatttggaacatacatcctcataaacatagccaacaaactcaccgacatttacattacgatttgcttcttgaaagatatctgttaattgtttaaataaagaggcgaatgtggtagcacgttgaattaatttgtttcgacttgtgatatttttaaaatcatcactaagtaatttaggcttatgtttaaaggtaggtacaaataaaaacaacgttgcgcttactacaataataaaactatgatagtaataatcatatgtaataaagaaagggagaactagatgacttacaagataaacggttgaacagactaatttattttccggcttatacataaagaaaatactaaaaggaaggattaatgatagtatttcctcttttaataagggattaataaacattaatatgattgatatatatagaatcgtaggcatggtactattaattcctaaataatagacacttagtaataaatagaaccttagtaatatcatcatatagacttgattgagctcaactaatgaaatgatggctaacattatcattgttgaaagaatcatcatccgtttattggtatatacttcaatcgtgttatggataaagagaggcactacttctaggtacagtagactatgtaatagtgtaaaggataatataactaatacttcaatataattatattgataaatgtaaagaaagagtaaacttaccaaagtaactactagggctaaatacttacttttgacaaattttaagtacatcatcacttgcataattatcacgctagtaatcgaaactaataatagcatatagttatcataagatatgtatgataccaataataaagcggtcatgtacataatgatatgtcgatagccgcacataaatgatactactagcatggggagaacaaaacacagtgatgtgtcatatatttttactaaacctagaaggagggttaatccaaagattgaaacataagtcattccagtattctttatttttgtttttgtttttgctactgtcaaatccatttcattcacctcgtaatatcgattatagatacttacagtagaataatttgtcactttttatttattttaaaataaaataaaaacttatagatttacaaacaaaaaaacaactagttttacaccagttgttataatcttaatttaaatccaatatcccccatgatcttagatgtttcatattgaacaaatccaagatttttaagcaaacgaatagatcttatgttgtcatcataaacatgagcaaaaacaattttaaaattatatctattttttaactccaataaaagtgctcgcatcgattcaattgcatagccatgttgccaataatcactatcaaaagtataaccgatcgtaatagaattagattctaagacctctaaaaaataatcacctatcaaaatattattttcttttaatactacacctaattgataattaccacgacttccatcaaaaggatgtttaacacaatactctactctttttaaggctttctggtaagggtaccgccaccatgattgatagaaagcaacttcccttttatcacgatattcactcaaacgcatagcatcttttatttccaactctctaattatcaagcgttgtgtttctagattttccatcaagccaccccgattcctctagatatcatatcataatatcattacctagtacaatcggtttattttagctcattattttatattttagcgtatttattacatgtttgaaggcaatgactggatgtttgaagataattctttttcctgaatatttcataacttctcgaatttgctgccgatatgttttttgatagcaatgaatcgggcatgatgaacaaaatgtcttttcctctttacgagggcaaaattcaattcgcttaaaagcataattttttaaatcacttaaatcgactttattaccatcttcatagattttaatcattatactaattaattctttttcttgatcaatcgtcattaactctgtcgcccctgttctattttaataattcgatcacagatttttaatgatgaaggtcggtgactaaccataataatggttttcccttgatgattatcacttagtgattttaatactaaagcttcatttaagctatcaagattactagttggttcatccaatagaatcaatggtgcatcatgtaaaaaagctctagctagagataatctttgcagctgtccccctgataaagactgataaaggctcccgatcattgtttcataaccatcttttaaactaataataaattcatgaagattggctttcttacaagcttcaatcacagcctcatcgctagtttccatccctaatttaatattattgataatactatcattaaaaacatatgtatcttgggtaacataactaattaatttcgctaaagaatcactttgccatgttttgatgtcatgaccattaatcagaatttctccgtcagtaggatcatagaaacgcatcaataatttcaatagcgttgttttaccacttccacttcgtccttcaattccaatgatttcaccaggtttaatacttaaattgattttatctaaaatcgtttcagcttcatatttaaatgataaattatttatttcaatcgttcctaaattcccctgatatccattgattacagtttcaacttgaggttcttcagctaataagtcaagaacacgatttccacttgcaaaagtaataactagattatgtgctaatgaagataaagccaagactggtccaaatgatgccattaaagcaatcgtactaattaaaacgccattaaattcaattgatccttggcgatataaataatatcctaagataaacattgctagtgaaaataaactaacacaaatatctccaatcattcgatattgaccctcaagatcttttaattctttattttgctcatttaataactcactttttttatctatttcttttaggcgtttattaccacgggaaaattgatcaataattcttagaccatggacagactctagtacataactagtatacttaccataatcattccgataatttaaccccatatttcccgacttcttaccaacaattaaaggaataattacaccaataaataggtaagcagtgcttgctaaaagacctaaagcaaaatgataatatccaatatagataatcataataatcgaaacaattaaagcaatcatcactggggaaattgtatgtgcataaaacacttctaaaagttctacatcgctagtaatcatggctaccaagtttccttgatctttaccatcaagttttgctggtgctaattttctaagtttttcaaaaacaatatctctaatcatcgctaataatttaaatgcgataaaatgattacaccattgttccccataacgtagaaagccccttaatattccacaagcaatcaataaatataataaactagtaaaagtctcatgcttaattactttaatcatgatttctcctgctattaccgttagaaaaatagcagccaagtagccaataacacctaaaataattgctccaagcatgattaagagcattgatttgactaaagcaatcaaactgattactacttttaaattactccgtttttgcatttgcctggcctccataattctcaatttctttttgggtattaactaactctatatattctggattatttctcatcaattctttatgatttccccagccaattaatctcccttgactaaagacatagttacatttacaattttcgacacttgctaaacgatgtgaaattaaaataacaattttttcatcacgcatctgctcaattactttcataattatttcttcactttcaatatcaatattagatgtcgcttcatcaaaaatataaacactagtatcatgcaataatgctcgggcaatacttaaacgttgtttttgtccaccagacaaattatttccacgctcttcaatttcactatccaaaccattaactccatcaaaataattccataaattaactttctttaatacctcaatcattatactatcatcacagttatcattcccatcacttaagttactgcggacagttcctgcaaaaatataaggattatgttcaaccattgttatttgtttcattaaactttgatgtttgacttgattgacttgatttccattgtagcttaaaacaccttgataattatcataataacccattaataatttagcaatcgtacttttaccactccctgagcttccaaccacaccataaataccaggttcatcaatttctaaactaacatccttcaatactatttcttcatcatatccaaacgacagtctagtaatttcaattttttcaatctcagtaatttctaattctttatgatcatttaccggtgtatctaataacctaaaaattttctcacttgcggtattaccattcatagcgatatggaaaaatgatcctagcagtcttaacggaatgaaaaactctgctgataacatgatcatcataaatgtttgccctaaatcaattgctccaccttgataactgtatagtgaaataataattcctagtgctgcaccaccataagcaacaagatccataatgctgatagaatttagctgcattaccaaaaccttcatcgtaatatttctaaatcgttgtgcttcttcattcatttcaagatgtttagcttgatccccttgataccctttcaatgttgtcaagccgcgaacattatctaaaaagcgttcagcaagattcccgtaaagaccccaatacttatttaataatcttttagcaaacttttgaactaagacgatcgataccggaattaaaggaacacaaacaaacaatactagggctgctttgaattctactcgtcccaaaataatgaacagtgtcagtggtgctaacatactatagaaaaactgtggcaaatatttaccaaaataaatctctaattgttcaactccttcgctcattaattgcgttaatgaagccgtactgattacatcactataatgattatttaataataatactttctgataaatatcacatcttagttttcctttaatattttttgcagctttaaaagaaaaagatgatactaatttaccaaaataacctttaatcaaaattaatacaattatgattatgattttaatactaaaattatttacttgatgcccctggtaaagttcattgatcatattagctataattgcaacaattactacttgactaatcaatgccagccactgcatcaaaacttgtaaataaatatattttttatcctcttttaaataactaactaatcttttattaatcattgctcacttctttaattgttttaattcgaaatgcaaaataataatacttaaatattactaataaaacaattgttatccttccataaatattatccatcattaaaaatgcaattaataacatcgtacttgcaaacgataacaacatcactttggttttcaatgtcatagctcttttagttacaaagtcatttaaatgattttgataaatttttgtcccttcaaaccagactttagcccgtgaagaacttttagtaaaaaagaacattgccactaaaagaaaaggagttgttggtaaaactggtaaaactacgccaatcattccaatccctgtaaatattattcctagcataaaatatagatatttcatatcgttctccttatgttatattcatctaacatactttaacatttacttttcatcttttcaataataagttagtctaatttaacaatttaatcaaaaaagaacttagtttctcaactaagttcactacttttaattatatctcttttttaataatgcaattccacaaagtcctgctaatgtagttattgcgtataatccaaggctcacactatcaccagtcttaactgaagttttaggtgtatcagctggtgtttctggtactggtgcaggtgttggttgttctgctgtttttccatattcagcagcccaattcataatactaacacctttagcatctttaggattgttatttaatgtatagatccaagaccagtgatcactatattgaactaatgttgctacaccatcttgatcataatcttctgcaaattctaatttattagaacttgctcctgtactaggatctgttactgctactgtttcatataaagataatttatattttccatctttagtttcagaagttgtaaaatcagaatttaaatcttgtttatgttctgaagtaattaattcttgtccatctgttaaagcattaaataaacggattgagcaatcttctggtttaacactgctatctgttttcccttgaactaaccaaattgcagtatcagaatttttaatacttgctaattctgcatcagttggagtttctccaccacgagcatctgctacatctaatgcaggacagttgatcattgcagcagcaaataaatctggataagcaatcaacattcttgttgtcatataaccaccagctgaacatcctgaaacaaacactttatcaggatcgatatttttagctttgattacttcattaatttcattatacgctttttctaataaaccatcattttgtgcataataccaagtatctggtgcttggaaagccataacatgagcccctccaaaaatattttgagtctcatctgtagcccaagcaactgtaccacgattagctaacatttgtgcaacattgttgccagaagataaataatcaccttcaccattaccatggaaccaaacaatcaatgaatctgcactacctgcatcataatattgataattaattccatcctttactttaactgattcaaatttagcagtttctgcatttattacagtattatcacaagtataattaccggtatatgaatcgttaataactgtaccatctgcagctgttaaagtaactggcttattttgtgtaaccgtataagttaattcagccggataatttctacctgaacttaaataagctaaagtggccccttcactttgattaaaatagatgtttacatattgtccttcaacttctactttaacaattttacggtcaagatcataatcaccatagctagtatcttgtgtaccttgacgaatatcttctgttgatgctttagcatgaacagtaaatgtatctaaccctacacctgtaacctttttagcagcaccatagtcaattaccatttttgatacgacctcacccgcatctgtcacttccccatataattgacagctataagtatctggagcatcaacagcaaataatggggtgcaatatgttgttgctactaatgcgaaacttacgaccatcgctaataatctctttaatctcttcatatctctttcctcctcgatatatttagtttatcaccctttctcattgaaagcgattacaaaaatacttactaagtaccataaataggtacctaaaaattaaaaaaactattgaatttaaaatctatttatgataatgattttaaaattgatacatgaaattatttttttaaatgatataattatattatctcaacgtgtagtttgcggaacgtaagtccagttgcagctacacttttttattatatggaggaatttatatgtacaaaattggcgataccgttttatatggacgtgaaggtgcttgtaagatcaaggatattgttactcgcaaacttaacaatatcgataagcaatattattttttaaccccattggatgatcatataactattcttgtcccaacagataatgaagaggctttatcaaaaatgcgaaaagtattatctaagaaagatatttatgaattaattaagacgatgccagataatgaaacaatctggatcaatgataaaaatattcgaaaacaaaaatataatgatattattaatcatgggaatcatgaacaattagttaaattgaccaaaactttgtatttaaataaacaaaaacaagaaaaagccggaaaaaaatttcatgttcaagatcagcattttttacaaaccgcagaaaaaatgctttatgatgaattttgtcatacactcaatttaaagccagaacaaattttaccatttattttagaaactttgaaagaaaattaaggagcatttatgtataaaattaataactatattattcataaaaacaatcatctttatcaaattatcgctattcacaatcacacttgcattttaacaacttggcaaaccaatgaaacaatcattacgaatatcaccgaacttgtccgaaaggttataacagcttctgaaatggaggaaattgttgaacgaattccatatattcgtactttaaacataactagtgaacgatatcgacaagagctttaccaaaagtcactagataaatatgatgaagttgagtggatcaagctaattaaaacaatctatattcgtcaccaaaaaaaacagactcaaaattatgaactaaaatattttaaagcagccaaaaatatttttcatgaagaaatatcacttcttctaaatattccactacctaagattgaaacatacataaaacagaaaattttagaaaattaaaaacattgacttttatgagtcaatgcttttaattaatctaaatcagttccatttgaagcaataacttttttataccaggcaaaactttttttctttgaacgttttaatgaaccgttcccttgatcatctcgatcaacatagataaatccatagcgttttgacatttcaccagttgaagcagacactaaatcaatacatccccaaggtgtatagcctaataattcaactccatcttcattaattgccttatccatctctattatatgttctcttaaatattcaattcgataatcatcatttactgaaccatcagctccaattgtatctttggcaccaagaccattttcaacgataaatagtggtttttgataacgatcatataaagtatttaatgtgattcttaatcctaacggatcgattgcccaaccccattcactagtttttaaatatgggtttttagttccctcaaaagcatttccagaagttttttcaacatttccttgtgttgaaatacaacgtgatgaataataactaaaagaaataaagtcaactggattattctttaaaatttctttatcttctgtggtaataccaatattgataccttcacgttcaaacatttttaaagcatagtttggataatatccacgtgcttgaacatcaataaacattatattttcccgatttttattaatagaagcccaaacatctgcaggatggcaactatatgcataatattcgcctccagccagcatacatcctaccatattattagaatcaatttcatgagcaatcttggtagcccaagcgcttgctactaattcattatgagccgcaatatatttagcttctttttgatcttcgccttctttaaacatcagtcctgcccccataaatggcatatgtaagatcatattgatttcattaaaagttaaccaatattttactagacctttatatcttgtaaaaagaacagtaactaattttttatacatttcaattaattcacgatttttccatccgccgtacttcttaattaaatgaataggcatatcaaaatgagtaatcgttactaagggctctattccatatttatgacattcattaaaaacattttcataaaactttaggccttcttcattcggttcattttcatcaccgttaggaaaaatacgagtccaccctatcgatagtctaaatgttttaaaccccatttcagcaaatagtttaatgtcttcttgataatgatgataaaaatcaattccaacttgagcgggataatagtatccctcttcaaaatctagcatttctttcattcctaagcaaacaggaaaacggtctttaccatgaggtactacatcaacattagcaagaccacgtcccccttcattatatccaccttcacattggttagcagcagttgctccaccccataaaaaatcttttgaaaaagccatctttcattcctcctttttactatatccttaccttactataaaaaaagaataaatacttaatagttcacaaactgtgaactaaaatatttactcttggttttgttgcaatctggcaataatcaaatctgtcacaaagcggatatttatcttattcaatgtagaatcaacagagggaacataaatttttttcccagcaaaagcaatttcttgattgcaagttattaaccaagccttttgtttttgctttaatattttagtaattgttcggtgattatacattagtgtattaccattaacactgataattaaaaatacagcgtgatcaccaattcgatattcttttctaaaatcaacatctactacaataatcggtatttgaagtgcatccaattcaatttggatcattgaacatagtccttttgcctctccatgacctaacaaaaataggcaagaacaatttctaatatcttctacgagcatatctagatcattataattgatctgatgtactgtattggttaataaattattcattcgcacaactaaatctgaactattacttctaaaatcactatctaactgaaaatatcgatcctttaatccaagacttccgacatacatcgaacaactttcttttaactcagcaaagttatcataacctaattctttaacgaacttcgagaccatggctttagaaacatgacttccatcagctacttccttaatagttaaggaattaattataagaatattttgtttaataaagctagagatcatatatctaggatcactcgtttgactattattgataatatcgtttaacttattaatgatcatcatatcccacctttatttcattatacaacaaaagcacctttcggtgcttatttaagattacgataaataaataacatacgatcttttccattaatatccttaatgatttcatggggatcgttaggaaaatattcttgaagagctgcttccataagctcccgttgatcaaatcccatttcaaatgctaataaagcccgttcctgcaataatggctcgactccctgaaatattttacgataaaaatatagtccatcattaccaccaaataaagccacatgtggttcattatctttaaccattgcttcgatttcttgttcttgaggaatatatgggggattagaaacaaaaatatcaacctttatttcattttctaataatggctctaacatatctccaaccataaattcaatattagcacccagattctttgcattatctttagcgactgtaactgcttttaaagaaatatcagttgcgaaaacttttagacgcggttcttctaaagcaagactagttgcaatcgccccactacccgttccaacatcacaaagagtaatgctttgatattcagcaaaatagtcatcaatacgatataaaatattttccactaattcctcagtctcataacgtggaatcaaaacgtcttcattaactttgaaatcacgtccaaaaaagttttctacaccttttatatactgaattggttttccttgataatattcttccatacctgccaagaacttggcttctagttctgaactgacttcttcatcatacattaaatataactcatgcggttgtttatcagcaaggtgataaaacagcactttagcaacattaacatctttactagcatcatctaatctgctttctgctaatttaatcagctcttttacagttgccattaatgttgaccttccatttttaaacgttggtcttcattaatcaaagctgtaataatatcatctaattttccatcaacaatacgatctaattgttggatcgttaaaccaatacgatgatcagttactcgattttgaggataattatatgttctgattttttcagcacgatcaccagacccaactttactctttctttcactaccaacttgttcgtcatgttgttgctgataaaaatcataaattcgtgaaactaaagctttcattgctttatctttattatcgtgttgtgaacgtccatcttgactagctgccacaattccagttggaagatgggtaatccttactgcagaatcagtcttattaatatgttgacctcctgcaccgctagcacgatatgtatcaattcttaaatcacttttattaatttcaacatctacttcttccatttccggcattactagaacagttgctgttgaagtgtggacacgtccttgcgtttcggttttaggaacccgttgtactcggtgagatccagattcaaattttaatttaccataaacatcttcaccctttaccatgaaagaaattaatgaatagccacctgcttcggcatcaatagcttccattacttcaactttccaaccttgagactctgcatattttacatacatccgatataaatctcctgcaaagatatttccttcatcaccgccagcagcaccacgaatctccataattacatctttattatcattgggatcctttggaattaattcaatttctaacttgcttataatctcaggtaagcgtgtttccaactccgctaactccattttagccatttctttaatttcaggatcactttctttagctagttctttagcatcgctgatcccagcttctacttctttatactcttgatataaatcatatgctgcttgaagtgatgactgttcttttgtaacttccgtcattttcttaatatcgctaccgatatctggatccatcagcatatgtcctaattcttcatatctattctccattgtttttaaacgatctaacatactctcattcatgatttatacctccaaacctctcatattatataataaacatactaaataagcaaaataaattttgtttgaattcatcgtcttttatttacattttaaaacttttaaatatttctaatattattatttagttcacattcagttcacctagctattttatgatattagtgtagtaagaaaactaccctccctttaatcataaaaacgaagacaagttactaacgtaacttgtctttattttgctttaggccgtactttttaaaagaaggttgaatttaaccagtgtgtctacttgacagcactaaaaccaaattaaaacctgcttctttatatttttataacccaaactataaaaatctctcataattagaatttatgcggtttattaggaacttgatggcaatgacgacatcttggttcataactttcatcagccccaaccatcacgatagggtcttcaaatcctgctggtttaccattaactagacgttgtgttcttgtcgccggggccccacatttagcacaaaccgctgttaactttgtgacaaactctgcccgagtcaataattcaggcatcacgccaaatgactcacctctaaaatctttatctaagcctgcaaccattacgcgaattcccttatcagctaaatattcacaaacttcaacgatatctttatcaaaaaactgcacttcatctattgctactacttcggtatcagcttcaattttctttaagatatcctgggctttttcaactactaaacaaggtactttagcaccagaatgagaaactatctcactatcagaataacgattatctattttaggcttaaacacaataatattcttcttagcatagcttaatacattgatgcgtcgaatcaactcttctgtttttcctgcaaacatacatccactaattacttcaatccagccttcacggtattgatgatacatctaattcctccttaacttctaagatcacgcacgccttcacttgttccgtctggacccatttgagccaaatcagaaaaacggctataattcttttcaaaagcaagattaacttcacctgttgccccattacgatgttttgcaataatgatttctgttaatccattatcttctgattcttctccaggatctttataataatcttcacgataaataaacgaaacaatatcggcatcctgctcgattgccccagactctcttaagtcagacatcatcggccgtttattaggtcgttgttcaactgaacgtgataattgtgataatgaaataactggtacttcaagttctctggctaatgcctttagcgttcttgaaatctcagatacttcttgttgtcgattttctttatttttagaagcagttgtaatcaattgcaaataatcgattacaatcatccttaagccatgctcactttttaatttacgactttttgcaacaatatcattgattttaatacccggactatcatctatgtacatattacatttagatactcgttctgctgcggcataatatttatttgcatttgtttttaaaatttcacctgttctcatagaagaaccttctattccccccattgaacagataaccctctgaacaagctgttcagcaggcatttccagggaaaaaatagcaaccggttcctcagctttatacgctgcattatgggctagattcaaggcaaaggctgttttccccatcgctggacgtgcagccaaaataattagatctcccttttgaaaaccagatgtaatcttatcaagatcacggaacccagattttaccccagatatatttccatcaattttttggagtaaatttaaacgatccgtaacacttttaataaccccacgaatatctctaaattcaccagcacttcgatcttgagttacttttaaaatcgttttttcagtttcatcaataaaagcatcaatattttcaacatcaccataagcattttcagcaatttgagttgtctcgcgaataattcttcgcaatgttgctttattatgtaatatcttcaaataatattcactatgcgctacagttggtacagattcacttaatctaagcaaataatcaacaccacctattttatctagctggctatgatccataagataagatgttaccgtggtaacatctactggagtgccttcttcattgattgcagccattgccttaaagattgcttgatgactgtcatcataaaaatcatcttcaactgttttattcaagatatcaatacacttatcttttgaaataagcattgaacctaataatgatctttctgcctctatgtcatgaggatattctcgattggccatacatttctcctatcgttcttttaaatgaacattgattgttgcaataattcctttatataaatctacttttaatttagtatatcctaatgctccaattggatgagcatcaataaattttcttttatcaattttaataccatacttttctcttaattgttcaactacttgtttagtagaaacgctaccaaaagttttaccatctttacctgattttaaagtaaattctaaagtaatgctttcaatttctttagctaattctttagcttttgcttgattttctaaatcttgttggtgctctgcttctttttgactctcaacaattttacgacttgtatttgtttctagaactgctaacttgtttttaattaagaagttttgtccatacccatcggctactttaacaacttctccttttttaccaactttttttacatcttgtaataaaataactttcattattcattcgtcctttcatctaaatattcgttgattgcttcctctaataaattaattgcaatcgttacatcttcatactttaattggcaagctgccatagaaaaatgaccgcctccacctaatttttccataattaactgcacattaacatcacgggtacttcgtgcactaatagatacctcttctttacctgtacgacctactgtaaataccgccttaactccactaatacctaatagctcattaccagcctttgctaacaatgttctactatatattttatcttgacgtccaaaagcaatcaagatattttcaccataacgatatgctgtttgcgtaattgacaattttgttagagtcgtatcataatcatcttctagatatttataagcttctgatacattcgcctgcatctcttttaatttagctgcagcctgaaatgttctagttcctacacgtgtcctaaaataattagtatcgatcaacattcccgcatacatgattgtcgcttcacgttcagtcacacaaacattttctttttgataatcaaataattctacaatcaactcaacagttgacgaagctgccggctctaaatacgtcagcaatggtaattcaataaattcctcaccacgacgatgatgatcaattacaactttatttttaattatatcaagtgcattagcatcgattgctaatgacggtttatgattatcaacattcaccagcaaggttttactgtgattaaattcattaattctagccggtgtaataaaaactccacgataacattcatcatcacgcaggctccgagcaattaccccagtcttttcttccaatgaatcataatcaataatgatgtgtgcctttttcccataggctttacaaattgaatacattgcgattgaagcaccaaaagaatcaaaatccgattgtttatgccccataattaaaacattattagcctgacgaatcaatcccgctaatgattgagcaattacacgggcacgaattttatttgatttttcatagctttcactatttccaccaaagaaacgaattggttcatcatttgatttaactgtagcctgatctccgcctcgagaataagccagcgaaagcgcagaaaaagccagctcatcaagttcacggagaatattacttcctcgtccaattccaatagataatgtcatcatttgtcctaactgctctgcttgttctttaaaataatccaagatcttaaacttatcttcaacctgtttacgataagtcctttcgttaaacattgcaatataaccatcacttttatagcgtttcaaaacaattccattttcttttgcccaatctaatacgatctggcgtgtcgttgattgaattgaagcagctgtttgttcatcagcctgttcaatcgactcttcatagttatcaaccgtaatatacgcaacacaaacctgctgatcttcaaactctttactaatccctacataatcacttacatcttttaaatataataaacggctttccttactattataaacctcaaatttacgagaattgatatcaatcaccttaatatcatcatcttcaaataaagaagctaataacggttgccattctaataattttttaccaacaatatttaatttcatctcagtaaataaatcactgatccaagaaatattccggttttcatcatatttaatcaggccgattccaccaaaaataaaggcatttttagcttcattatttaacgcttcactaacacttaaattattttcattagccaaacttgatgaataaaagataaatcctagaacaataacattctttataaatatatatgtagccagaactaaagatgtattactagaaagaaatacatatcccatcaaagcaaatataaattcaatcaataataaagcaatcactacattctttattcgtgtcatctttactgtcatttagctcaccacctctagaataatatcattatacattaattttactttcttttcatcaatttgcttacgattatatttgaatacacacgaacgatgtaagattcactaataaatagaaatatccacagcaatgcaaacgatacttccggtgttagaatattttttaacattggtattaacgaaataatctctctatacatctcaagtccctcttgataaacattgattcctaataatcctcccaatagaaagaaaattaaaaagttttttattgctgaaatgatcattaagccatatttagaaaaacatttctgcttttcatgttttagacaatacccataaaatatccccatcactaaagtaaaagtaacataaaatgtaaaaaataattcaccaactaaaaataaaattacaaaagtaactgctaaaacactcaatcctgctcgatagtcatataaataagtataatatacaagcccaataaccataacataagctaaaacaatatcaaagatactcccagtataaagattaataactcctagtacaccaaataatgatgccaacatcgcaccttgtgccatgactttaactttattaccattcaccttaatttcctccttaaaagaaaaatgcccgcaggcattttattcaaaaatatgatagctcttttttccattctttttagcttcgtaagcagcactgtcagcttgatgataaatttcatcaaatatcactcgaggagtctcgacaaaagtgacaccaactgaacatgaaatatcaattttacttcctggacaagtcgttgctagtgcctcactaacctgttttgccttagaaataacatcttttttagctcctacttctttcatatagaccatgaattcatcgcccccaaaacgaccgacaacatcatcaccacggaataatgactttaatcgattagcaacaaaacgtaacgtttcatcaccagcactatgtccatttgcatcattaactaatttaaaattatctacatcaatcataaataaggctccatagttacctggttcaactaactgaatctctgatgtaattacccgttccaattcacgacgattaattaatccggttaaagcatcagtccgcgcctgccgtgtcaattcaatcgtcttacgtttatcatcatcaatatcgttagcataaaaaaagcccatcaactgattagtttcttcattatataaaaacatcatatgcgtagatacccaaccataacgctttttcgttggacgataaaataaaaaactaattctcagatcatctttaccatcatggtaagcttgacgtacattatccaatccaaaagtatctaaaaataagtgtttatcttcatcagcaactaatgtaaccatctttttaataaattcactataacttgctttttcatctaatcctaaaagattataagtaacattgtgtgctttaatcacttcatcagtagttaaattaacttcaagatttgtaattgagcgttgcattaatttttgacgatatttaatttcttgaagataacgtgactcaagtcgcacttgctcatcaatattttggtaaactccaacggctttgatcggctgattgtcatcatcaaaaatattagtgaatttaacatgaatccaaatatatttatcactattaagtgcacgcatttttaatttaacttcccctgtttttacgccaccaataatctgatgataaaaatgataaaaatcatcaaatgaacgttcgtgaatcaaatcactatcaatcaatgattctgggatatttgaaaaagcagctgaatcaaaatacgctgcactactttcacttgaacaagaaacctgtttactacgatgatcatattctaataaaaatacattactttgattaaatgcaatatgatacatttcctcattaattcgcgatttttcttctagcaggcgttctttagaactatcggtaatcaatccaacaaacacatttcggccatcttcagtgccaatatagttcactctaaaatatgtccacatcaatgtcccatcattacgaaaacaacggcagccatgctcaaatgattctctattcttagtagcttcataaaattcttcttgtagaggtgctagatcaggttgataaacaatttcaaaaacatcactatggaaaaccgttttaaaagcttctttactatatccaaataactgataagttccgtcatttgaaaataatgttttaatcttattttcctgcatttcaaaaacaataatcccacctggtaaattattaatgattttatccatagatgctctatttttctgattaaacagtctatcttgatattccatttccagacctccattctttgtaagatacttgaaaattatatcacaataatatcacttcttcaattgtgagattatcgacaaaaagtctgataataaccaaataatttacattattcacctaaaaaaaggaaaccctaaaattatatcttaatacaaaaatttaaaataaaaataaactatcttaagaacagtttattttttctctaataactccgtcgtttcccgtatactctttgctgtaagggtctgagaagttgtaatcatttccttgggggttccctgaaatacaactttgcctccatttttaccaccttcaggaccaatatcaatgatccagtcagcctgtttaattacatcaagattatgttcaattataataactgtattaccgctatcgacaagcgaattaaataatttcatcaatttcgttatatcgcacgggtgcaatcctgtcgtcggctcatctaatatatatattcccttttttattcaaagcttgagctaacttgatcctttggatctcaccaccagataaagctgttaaagactgacctaaggtcatatacgataatcccacatcgactaattgttgaagcttcttagtaattttagcattatcaaagaagtcaagaacctcctcaattgtcattacttttcctaatcccgaacatactgggcaggatcattaaaagaaaaacacgcggcactgccaaaataaggcttaccaatacgagaaaataaaatgcgtaaatcagtatacaaatcactaattgttccagctgttgaacgaatattcccacccaaagaagattgctcgataataaccgctggtgacaaattttcaatactttgaagatttggtttaacatattgtggcaattttccccttataaaagccgcaaaagtttcatttagctgacgacctgactctgtggcaatcgtatcaaaaacaatactagactttcccggccctgataccccagtaaagattacaattttatgtttgggaatatctaaatcaatatttttaagattattttgaatcaaacctctaatttttattttgtccattatattcccctatttaaagaacagataactttaaagttatctgttcttatttaattattcatcaaatagcggttctagatattctttaataaattcaattcgatcattaacatctggtttaaacgtagcagtaatcgatattactatttttttcatgatatttacataaataacatttcccccatcacccattgccataaaaccatcttgatgcagccaccataaatatccatatgctaaattaagttcatcattataactttgtttttttattgaatcaataacccattgctttgaaacaatttgttgcttattccatcgtccttgatttagatataattgcccaattttagccatcgccctagttgataacgtaagtccccatcctgctgcattaatgccacatgaatctatcacccagccgttaatatctttagctttaagaaaagctacttgttcctcctcacttctaaaagtgattttatctttaacttcaattccaagtggtgtaaataaatattcagtagcaaaatcaaatactgatcttcctgtagtattaactaaaatacctgataatatatctggcccaattaatggagcatactgaaattttccaatttcaccacaatcacctagtaaattaagggaaaaagtaacccagtctttacttgtaaaatatttaatataagaatcttcttgatatttgtaaggtacagtcatcgtcatcatatctctaatagtaattttttgaattgccaaattattgttttttattacataattcggaaaaaaatctataatcttttgatcaattttttctatataacctttatctaaagctatcccgattaaaattgaaataatacttttagtaacagaagcaacatgtaccgtactatttacgttacccccattaaaataattttcatattttgttacaccattttttaatccaataattcctgtaatattatcatattttgtattaatgatttcttctaactgcattattttctcttggttcatctagttctcctttattttcatcaaactttaagcttacttactggataataaacttcagtaataagttctttgtcacttgtaacctgtgatggatcatttacatatacttcatacaaaggggcatcatttttataacctattttttccgcccattcacattgtttaatatataccgaagacaaattagaataagagccatgaacaaccgttttaagacatgttcccggtacaaattctctagttctattatttgtttcttgtacaggaatggcaaattctgtatctaacccttgtaaagtaaattctgagctgtggaaaagtaccatcggtggcgcggttactgttaacttatcggtcataatttctctaaacaattgtccaaaactattactgtatgcttcagcaaattcatcttcttgaatcattttacgaatattcagtaaattcataggcggtatttctactagctgcacatcaattttatctagatacgacataattgattttccttgttggagagttgtgatatcctcatgcagctgcgctaaagaattttgataattttggatttttaaatcaatctcctttttctttttcattaaagctttacataatttttcatcctgtgcttcttctgtttcaagaatttctttaatttcttctagtgaaaaattatatgattttaagcgattaataaataacattgtttctaactgatcaatagaataatatcgataaccattttccagattgatctcatcgggtaaaattagcccaatttcagcataatatcgtaatgttttagtcgaaacttggcatatctttgaaaactccccaattgataacataaattagtacctcctactaatctctatgttcatcttacaccttgccctaaggggaaagtcaatgtaatctaattaagttttttataatccacaaaaaagaggaccttagtcctcaaataaacatgctccattagtttcaattacctttttataccaataaaaactttttttaggaattcgtttgtatgttcccttaccgtaatcatcagcatctacataaataaagccatatcttttactcatttgctttgtcgattctgaaacaatatcaatacatccccaagaagtatatcctaaacattcgactccatcaatttcaatagcattaagcatttctttaaaatgacaatcgaaataatcaatccgatattggtcatcaatagttccatcaggtaaaactacatcctttgcacccaaaccattttctacaataaataacggtttacgataacggtcatataaatcaaccattgaaattcttaaaccaattggatcaatttgccagccccattcacttgaaggcaagtaaggatttttaactgctgtgacagtatttccaactgctgtatctaaaccttcgctactagcagctgaacatgatgacatatagtaactaaatgatacaaaatcaacaggatactttttcatcacttcatcatcaccaggttcttttacaatttctactccctcatttttaaattttgctaataaataagcaggatattcaccaaatacttgagtatcactataacaatatgtacctctcatatcttgttgggcttgtaagacatcttctggtttgcaactataagggtagtatgtcagtttagtcaacatacaccctaccattgaatcagaaataatttcatgacaaatttttgttgctaacgcactagctacaaattgatggtgcattgcttgaaaaattacctgattccatttaattcctggaaaacgatcttcaatcaaaccaccagtagtataaggatgacgaatcatactatccacttcattaaaagtaagccaatatttaactttatttttataacgttcacaaattgtttttacgaacgtttcaaagaatccaactaatttacgattataccagccattatattttaatactaaatttaatgggggttcataatgtgacattgttacaagtggttcaattccatactttgcacactcatcaaatacatcatcataaaattttaagcccgcttcatttggttgttcatcatcaccattagggaaaattcgcgaccaggcaatcgacatccggtaaactttaaaccccatttctgcaaacattttaatatcttctttataatgataataaaactgactcccatgccgttttggatacaaactatcgtcatcacttgctaatgcttcttcaatatctttactagtaatatgattatgagctttataattttcaacatcaacatcaaggtgatgacgggcacaatcagaaaccgaaataccttttccaccttctttccagccaccttctacttgattagctgcagttgcaccgccccataaaaaaccttctggaaattttctcatcataactcctcctatataattttattataagtttttaatcagcagttgcccatatcgatatattgtttcggttagaattatcaaatattataatttgttttaagcttttttgaaattatcaaccattagtcattttgccaatcatagcgctgcccaatcaattcttcaagatgccgttctattttatcgtaattatgaacaattaaagatgctactaagatatctaaaatatatagtgatgacatagtaaaaattactgttgaaaattcaaaggtattttctgttatcataatttgaaaattataatctgttagattcaataaccgcttatcaacattcccggttattgataaactagggatattatattgttttaaacgtttcgcagcatcaaccatactcggatttttaccagtatgtgataataagattgaaaatgaaggaattttatcttgctgcaatcttttacagtgattccactggatactgttataagcatttgctgaaattccgatttcgtcaagtttgtaacaaatattacgagcaatttcaaaattgattccatcaccgtataaatcaattacttgtgctcgcttcattaagttgcttacgcgaataaccgtattacgatcgagcatgctgcgagtatgatcaatagcacgtgaataaattaacggcatagtatgaataatatcgtcaattccactatttcgactgaatggtactacttttaatgaatcctttaatttcatcatttcaggatattctgatacataaataaatttcatatcagcatatcctttagtacctaattttttacataatcttgtaattgtcgatgcactagtataacttgcattagctaactcattaacactcatttccaataaagctttaggattagcaataatgtagtcgacaactgctttttcttgattagtaagattttctagggtattcattttatcaataatcatctctctatcctcgcgtatcttatttttcttcattataatatttttattgacgaagcaacatttttttcattttctaaaaattactaattaaaaatccccagttttaactggagatttaaaaaattaattgaattagatagcaaacatagagcacacaagtcaaagtttgcccaattttttctgtgatatcaaaagtagaatcctttttccaaacacgatacatcgcaataggtggaaataaaataactaaaaaatatgtgatgattttatatttagtgaaaggatgtaatgctttttcatctggtttattgagctcctctttcatccttaaaatattttgttgtcgtagagtcaatccccgattgttctgtttgattacttttgttgccatctctattctccttgattaattttcttgcttatttgcagcaaaaacaaatggtaaataaacgataaatgataatactacacaaagggcttgagtaataactgccccaatacttcctcccgaacctaaccaggcaattagtaatggtggagtagtccacggaactgcataaatcatttttccacagaaaccaattactgtcataaaatatgcaaatgttgcggtaatgacaggtgttaaaataaatggaatcataaaaattggatttaatacaattggcaatccaaaagtcattgtttcattaatattaaatagcccaggggctaaagatagtttagcaattgttcgatggtcggaacgttttgatgccagcagcatagcaaataatagtccaatcgtacagcctgctccacccattgttgtaaaacaactaataaatgtttcatttaaaataaattgtggggtttgaccattagctgcagcatcagtatttgcgataacagcttctaacatggttgcttgataaaccggttttaatacttgagtaccatggataccaataacccagaaacaagttgaaaggaagaatattaataaatatcccggtaatcctgtcaaaatacctcttaacggcgcttgaatccatgttgaaatcatattgtaaattgaattccctgttacttttgtaaataaaagtccaaaggccgaaataatcaaaattgtaagtactgccggaaataatgcattaaatgctgatgaaacatttgatggcactgattcgggcattttaattgctaattttccactatctgctaagcgacaatatatttccattgaaacaatagctacgatcattcctaaaaataatccttgtgcattagtaaactcacgcggcaatacattgactacttcaactaaatcagttactccctcaactgcaactttagtaaacgaatcgcacaaagatacatatgcagaaattgcaacaactggtgccactgtctctttatgtcctaattgtttagccatttcaattgctattaacactactgtaccaatcgtaaagaaatttaaagtagcgtaattagctgcggtaaataatggtgtcaattcttcaagccaagcaaatccatcaattttagctaagctgattcctgtagtagttgtactacacacaacattactaaacagcgtacaaaatgctcccgtaataataattggcagcaaagcagtaaatgcatttttaatcgctgtcatatgacgttgattagaaatttttgaagcgacctttaatagcccctcggtaagacgatcagtcatactcataactctttctccttttatcaattaaaattttattgtgcacaaaatttaatttatagaatgattgtaaccgctaacaaattttagttctaccgtagaaaattgctttggttgaaaaacgtcaagatattcaatatttagttttactttttgaaaatttcgttcaaaatttaataaataaaaactattaaaactttctctctaacagccaactcaatctaaatttatttactatccttcacaattacctgttttaaaatatcttattctaagccgattacttttcctaatttgagtccaatcctcataccttcagttatacctctttgaatccattatcatgatgcctatctttaattgtaatcattttttataaacaacttgaatcataaaataataaaaagagaacttagtcctctagtatagatgccccatttgtcgcaataacttgtttataccagtcaaacgaatcttttttataacgtttatatgaaccattaccataatcatccacatcaacatacacaaaaccataacgtttagacatttggtttgttgaattagataccaaatcaatacatccccatgtggtataacccattagctcaacaccatcttcatgaatggcttcatacattgcttgacaatgttgttttaaataatcaattcgataatcatcatgtaccttgccatcaatcaattcatctttagcccctaagccattttctacaataaataacggtttacgataacgatcgtatagatcaactaatgatactcttaaaccaattggatcaatttgccaaccccaatcagaactaggaatatgaggatttttaattgcagttacagtattacctgcagttttatttaatccagtatcatctttagccacacagctagatgaataataactaaatgaaataaaatcaactggatattctttcataattcttaaatcttcttctgtcatattaatattgaagcccttatttttatacatacttaataaatatgctggatactcaccatgaacttgggtatcagagaaacagtaaattgagcgcattctttgttgtgcttctaaaacatcttcaggtttgcatgtatatggataatacgttaatttagtcaacatacaccccacttttgcatcaggaatattatcatgagtgaccttagtcgctaaagcactagcaacaaattgatggtgcatagcctgaaaacatacttcttcaaattcttccggtttaaatcttgattcaatcaaaccaccagtcataaatggatgtctaataattgaatctatctcattaaatgtaagccaatatttaactttatttttataacgtttagttattacatcaacatatctaacaaaaaaatctattgctcgacgatcataccagccattatactttcttgcaaactctagtggtggttcatagtgtgacattgttactaatggttcaattccatactttgcacactcgtcaaatatgtcatcatagaattttaatcccgcttcattaggtactaattcatcaccattgggaaatatccgactccaggcaattgacaaacgataaaccttaaatcccatttcccctaataatttaatatcttctttccagtgatgataaaaatcactagcatgtcgttttggataataaacttcatcatccgttgctaatgcctgatcaatcatttcatcagtaatatcacataatccatgtacatcagttaactcttttaaacttttaggatccgtaaataatgccacgtcacttaccgaaataccttttccaccttctttccaaccaccttcaaattgattagcagcagtggcaccaccccataaaaatccttcaggaaattgttttgtcattttatcgacctccgtattctaatttattttaatgttagcactattgattattaatttcttatttgtttcatcttatgaaaaacaaaagcagtagatttctctaccactttcgttaatcaatataattatttaataatctgccatcagcaaaattaagctccggataatgagcttttaaattttctacaacattactgataccgctacctccagatgtagcgaaaggtacaatttgttttttagaaaaattataactttccaaaaaggtatcaataattcgaggttcaacataccaccagattggaaaacctagatagattatctcatattgatcaagattatccaatttgtttaaaatctctggtctacagctttgcgccttcatttctaaagaactgcgactattatcatccatccaatttaaatcagcacttgtatactcgatctttggacaaatttcaaataattccgctaattcttcttgagccagtctaagtgcgactttttttgtaacaccactagcactaaaatacgcaactaatttcttactcatacatttcctcctaaacaataataaaggtatatctctatacctttattataagatgactttaaataaagtctaatacttagtttttattagtagtaatgcttattaagcatctatgctgtttgttcaatttgtgcctgttgtttttcatatagcttaacaaaaggtaaatagatcaatgcagataaaatgattcctgctaattgacaaattggcgccataaaattacccccagatcctaaaaatgcaattaacaacggtggcattgtccacggtaaatcgacatacataattggacaaatatgaagcattgtaagaacataaccaaaaataacagtaactagcggtgctaaaataaatgggatgattaaagttggattcattacaataggaaccccaaacatactaacttcaccaatattaaataattcaggtactaaagcaattcgtgcaattgatttattttctggacgtttacaaactattaacatagctatcgtcaaacctaacatacatcctgttccaccagtggcgaagaaagcccgatgaaatgtattattgacaatattacttggctccaaccctgctttaattgcatcaagattttcaacagctaaagttgttaaaataggattgaaaacaccaccaatcatgttatcaccatgtaatccaattgaccaaaatactaaactaataaacataaatgttagtacacccggtaaagaaccacctatatatagtaatggcttttgaataacattaaaaataacatcattaatgtagactcccgataccgcatttacccccaaaccaactaaagaaataatcaaaatttcaataaatgcaggtactaaatattcaaatgatttagcaatttgtggtggtacttgatctggtaatttgatttttaacttatcaagtttaaataatccacaaaataattctactgccactatcgctacgatcattcctgtaaatagtccttgactccctaatgaactagtaaagattccactcacagtttgaattaattcacctcccgctttaatatctaatgatgtttgagttacagttaataatgaaacgactgctaataaaccacaaaacattggactgctttttcgacttgttccaatttcaccaccaactaaaaatgtgattgcaacactgatacatccaattgtcgcaaaatttagtgcattaaaagctggatttaaaaaacttaaattcattaccgctggtactaaggcccctaatcccgtggtatcattacaaataacatttgaccataatacaccaattgctccaataatagtaaatggaacaaaagtctgaaatgcattcttgattgatgaaagataacgattttcagcagcaaaaacgcctactttcatcaatatatcttgaaatttatccataaaattcttctcctcttttaaaaacattgtacttaatcttcgctagcagataattaagttttttcaagccatattcatcttagcaaaaaaataatcataaataataaattgtctagatacaggaataaaagttcaattatttagatttatcagtaaaatatttcgtacttttagtcctatttaagttttcaaatctttagtaaataattagatactcaattagttttacacaaattgtaatgtactattaaaatcgtataaaataaaaaagattactcgactgagtaatctttacaacctaaaaacaaataaattattattttaactttgaaatacctgtttccaatatttccatttgtaataatgtttgttcatgagtaataatctgaggctgatgcttaacaatacaatcatagataccatcatacactcgggcatagtcccctgttacactaaccactttttcttcgtgataaaaaccatcttgatcataatagataagggtaccataatgctccggtgtatcaactccaaaatctttattcgtcggcatataaaataattttaaatgttcttcttgacgatccttgctctgtttaataaacattcccttcttaccatatacaacaaaactaggtctttctttaactctaaaataacttgatttaacagacactttcaacgttccataatacatatctagatcaaaataatcattaaaacgcccctctcctaataattgacgaacatcataattaattgtatcaggttttccaaaataactaataacctgatctaatgtatggcaaccatgcccatataaatatgacattgcaggatcaaaatgattgattttttctggaacctccggacgataataatcaaaatgcatttctaattctaataaatctcctaatttcccactctctattactttttgtaccgttaaaaaatcactgtcatagcgcctattttgatatgctgagcaatacagccctttctcatcagcaagagcaaaaatctctttagcctgtgcactattttccatgaatggtttctcaactaaacaatgctttccagcatttaagaccatttttgcataatcatagtgtaagtgatgagctgtacaaataacgaccatatctattttaggatcattcaatatcttattaacatcctcaacatactcaactccatcaatagttttccataaatcatgtctaatcctaatatcaaatatctttttaacaataaacttatctgatctttgtaagacaaaaggtaaatggtaacgattagcacttttgccattcccaatataagctaaaactaatttattattaatcattttcagatactactcctttctattattcataatatttatattttatttttctcatcatgatattttgataaaacatcaacaattatttggtgatcctcattatgagctaatccagatacaataacacttccaatcatccctttaccaacaataataggataagcaccaccacatatcacatatctttcatcattagtgtattgctgataacaatgacttcgttcattctcttgccaaatttgataagttggcaatttaaatagttctactgtgttttgtttacgatttaaccattgatcaccttttttgccattcatcaaatattgaaaaacaatatcttgatttaaaacaattctgattctaatattttttaagttttctttttttactttttcaactaaattacaaccaagcaaaaaagcatcttcattatcaaacttattaaaagcaattagtttttccattttatcaccccatttatttatatcataaatatttagaggttttgtttattccccttatttagtatctaaagttctattttaaaaccataaataacaatttataagtacctttagacctaaataaaaaggagtttaattaaactcccactaaattattaaatttctttttcttagtaacaaaatatgcaattataattgatgaagctgttaaagcccaactaattggataaataatcaataacatattatatgtattgaaatgcgggaagactaaaaacatataacctaaccgaaccccgcaagtaaaaataacacataataatgttgaaatcataggactgcctaacccccttagactacctgacataatttctattgtcatatttaaaacttcaaaaattaatatatatgtcattctgattgtcgccaactcgacaattttaggatttgaggtaaatatacctgcaaagaaccgatcaaaaacaataaatatcatacttaatgagactgtaaaaatagtccctaagatcatacagcctcgagtagatttgatacatcttttatagttgcctgctccataattttgactattgaatgtaatactagcttgtgaaaatccagttattaaatagtatacataaatttcaaaattcaaaccaactgttgaagccgcaacaacatcagctcctaaactgtttattcctgattgaataataatattagaaacattaaataacatcccttgaatagctgcaggaatcccagtaaataagatatctttagtaatagtcttatctatttttagtttttctaacgataatttcaatggtccctgttctttagttaagatataaaataataataaagcactagttgcatctgcaatcagtgttgctaatgctactcctgcaacatctaatttacaaacaacaacgaaaaatagtcctaaagtaacatttacaacaccagaaatcaataagcagtatagtggtcgttttgtatctccaccggcccttagtattgctgcttcaaaattataaatcgttaaaaaaatcattccaataaacgtaatccgtaaaaacaaagcagcttgatcgagtacttcttttggtgttgacataattttcaatagccagactgcaataacttcaccaattaaagcaatgacaatcccactaataatcgaaagtaatattgaagtatgcactgctttactagtatctttttcattttgagcccctaaaaaccgcgaaataacaacatttgctccgattgataaaccaacaaatattgtaataaataaattagtaatcgggctggtactcccaaccgctgccaaagcattacttcctgaaaaatgtcctacaacagcaacatctgcagaattaaataactgctgcaacacacttgttgctgccaacggtaatgcaaatgccagtattttgtcccaaatacttccgttcaaaatatcaattctttttttttccataataaatcccccaattttctcacttattataaatcttctactatactttaaggcaagggattttcaaaaactgaaaagaagcttattttccaagttttactttatctaaaaataaaacgtagcacttattcaactacgttttatgaatacttcattatatacaattttaataacagtaaatagttaatatatctgtaatatcaaaattaaaaaggtattgatcaaaactaatcaatacccatattatttattcactttttaattctcgtccattcatcatattacgacatccatataaaatcaaaaacgatattgcaaagtttacaaatagtgcaacatagctagctgccatcatcgccacggtagtgccgctattcaacaagatggcagtagtgattacagcacttggaatcgcaccaatcaacatcactatcattcgcataaaattctccatcattggtgaagttcgactctttaaaagtctaacagatagtacacttccactaataaagatactagtataaccaataacatttaatagatagacaatgatcatcattagactttgatgataatataggcccattgcaataaaagaaacagctgcaacaacaaatatctttataaatgttggaatgattaccgcaatcaatttactaaacggcttatcaggaattaaataaatttgataattttttaattctttagataaatctgaattttgtaaagaagaaaaaatccaaattaccatcatataaataaacattccaaacccaacgtcaactgctattgttactgcaatatatattccaattgaaatcaaatcactaacactaataaaactattagttttacgcattaataaaatattttttgacattacagcataagccccttggcgaaactcccccttaatcccaagctttactttcttatttcttaaagcctcctgatctccggctttggccgctttcattcgttttgataaatctagagaatcttgtaaagcctgttcataaaaattacctcgataaccaataaataaaacatatactaagattacagctccacacaacaaaagatatcctaatgttactaacaaatagttatgctcaacataagcaatcaaagctaacttcatccacccaaaaataggaactacataaaataaatttgattgcacaaaatccataaacaaagtatgataattacccgtttgaagatataaaaccaaaacgataattacaacaaaagcaataataataccaggaatgattttcgaatacttacgatattttttatccccaattgataaaacataaagataatctgttaataataagaaaaacaaaacagtgataacagatgctaagtaagctagcacaataaaaataaaattaaatccggcaccaccgctaaatgcagctaaaaatactaaactaatcaaagcaagtagaaaggcctgaataattgtttggaaagttaaatagctcattacttgtcttctagtaaaaggacctgtaaaaagatagaatgcatcctcacctgtaaataaagctttttttgactgcatcaatgttgcaaatagcataattgcttgaaaaccaattaataataaaattcccatgtgcaaatctatattattaacagccataatttgacctgcatccacattgaataaactaacgatcattgcaccatagaatagaatcataataataacaaatactccacttgctttacgtttaaataagtttctgattgtccctttgatttttaataaccatagttttaataacggtttcatcttactcaccatccgttaactcaaagaaatattgttttaacgattcatcttctaattcatcacgtaaaacgtgtttaataattttacctttattcataatataagcttcatcataaatatccttaataatatcaatgatatgggtactaacaaaaactgcacaaccttcttcctttagcaacgtaaaaatttttaaaacatcttcaatactagctggatctaatcctaccatcggttcatcgactaataaagcttgtggctggattaagagtgctaataacatactcagcttctgtgtcatccctttggataactctttagccatgcttttccttttccctgttaatttaaataattcaagatatttattcgcaatctcgtgataattgtctactcgatacgcatttccaataaaatcaatatgctcatcaatagtaagcagatcatacaaaatcggtgtttctggaacatatccaaaacaacgtttagcctcaatactatcattaggataaccacaaattttaatctctccatcaaatttcaaaagattagcaatacttttgatcgttgttgatttaccagccccatttggtccaagtaagattgtgacttttccccctttagcaactaaatcaacattatcaacagctctaaagccatcataaatttttgttaaaccatttacttcaatcatttcaaattccccctagtctatatattcactatactctaacgacctagggcactgtcaaccattcatgcaataattaatactttttaagaaaatggcactaaatagctatactcaccaaataaattattgtgcttaaatataataaacagctattttaaatatcaacaataagaagcttactctacaaattcattatacttttgcttgataatatctgttaaacggacatctggatgatgatatttctctcttctttcaatttctttttctttagacatatatatcgctgctgttggacaccaatgaaaacacgctaaacaggtcatacaattatctttaattttaatttttccttcaatcaactcaatattattcattggacaaacttttatacatgtttggcacccgatacacttctcgtcaactttaattccacgcatattacaagctttatatactgcagaattttcaacttcaggtaataatgaataatctatcttatcttgttctattattgattttacaagttttttgatatttgtcttttgattagctaatgtgtcttttatttgttcaacagtactcaaataactattaccaggcattgggattcccttacttagtgctaaacttaaatttttttcttgtaaaagattatcaaatctttttgctacatctccgggatgtcctctatatgttgtgaatataaaaatataagtattctgcttaaatttcatttttctaatagtatcccttataagatatggcatatccccatagtatattggaaaaacaaaccccactcgctcataatcaacttcgatatcttgtttattgtgaagtgctgcaagcgatataacatcacattgcccatcaagagatgctgctaatagttttgctgttgtcaaactattgccggttgctgaaaaataatagattcctgtcttcatattaaccccctataaatactttactacttttagaattcttaattataagtataaccaaattaactaattttgatagtattctttcaaacacagaaaaagaggggctcatgtttttatgaactcctcacgtgtcatcaaatacttaacttaatgatatcgaagcttaactttcctcaattactcccattaactctaaaatccgatttaaatctttagtatcagtatatttgattgttacagccttttcatcaaccttgatcttagttctaaatttctttcttaataacccttcaacatagacatattcctttggtttttcaactttaggacgatctttacgactattgcctaattcaattcccttaacaatgttttcaacatcacgaactgataagccttcttcaatacaacgagcagctaaactttcggctttttcttgaggaagagtaattaaacaacgagcatgccccattgtaatttttccttcaagtacataattttgaatcatttcaggtaattgtaataatcttaacgtatttgcaatataacttcttgatttaccaattcttttagctaattcatcttgcttaagattcaatctctccatcatcatttggtaggctttagcttcttcaatagaatttaaattctctctttgaatattttccaataatgcaatttccatcatttgttgatctgtaaaatctacaataattgcaggtatttctactaatcccgcaattttagccgcccgacatcttctttcaccagccacaatttcatatccctggattgatttctttaaaatcaccggttgaaaaacaccgtgttctttaatcgaaattgcaagttcttgtagcttttcttcatcaaataatttacgaggctgataaggattaggacgaatttcttctaaagaaactgttatctgttttgattcaggtgtatttttttcaatatcatcaatcaaagtactaatatctccaccaaaaatagcatctaaccctttacctaactttttatttttagttgttgccggcttacgagcagcaggctttttagttgtagttactgttttcttagttgctgtttttttagccgccatctttgctggggcactttttgttgtattatttggcatttcgtttacacacttcctttgcaaaatctcgataagcgcgagctccttcagaattattatcataatcaaaaatagctagtccttcagaaggggcctctgataatttaatatttcttggaatcgctgttttataaactttttctttaaaatatttgcgtacttcctgtgatacttcaacccctaaattggttctttgatcaagcattgttagtaatactccttcaattgttaattgtgggttgaaaacactttgagttaataaaacagtatttaataattgtgtcaatccttctaatgcataatactcacactgaactggtattaaaaccgaattacacgcagtaagtgcatttgtatttaataaacctaatgctggtggacaatcaataataatataatcgtatctatcctttattttatcaagcgctttttttaagcgttgttcacgacctttttttacgttcgctaattcaagatccgcccctgctagatcaatactacctggtgctacatctaatttagcaatatatgaaggaacgataacatcattaatattacactcttcaacaattatattgtatgttgataattcaatatgatcgcggtcaattccaatcccttgagttgcgttagcctgtggatccatgtccacaagaagaacccgatttttagcatttgctagagcggccgctaaattaatactcgtcgtagtcttaccaacgccacctttttggtttgtaatcgcaattatctttgtcattatttagcctccctcattaatatttcttcccaatagtttcacctagtttaactacggtctctttatcattcatactattttcaattatatcgttatcaataacaacttgattttcttttaataaaataattactgttgaaccgccaaattcaaagtaacctttttcttcacctttaaaacattgtttcttatcatggttaacgattctaccaaccatcatcgcaccaacttccatttgaatcattttaccaaaatttttagattcaattatcgtatagctgcgactattctgcttataaatcggataataatcattagcaataggattaactgtatgaaatctacctttaatatatttatttcctataattttcccatcatcaataaaactataacgatgataatcatctactgtcaatctaaaaatcatccaataaccattcatatattccttagctaactcatcgtcttctaataattcccccaatgaataccttgtatctttaatcataaaacggctatcttgatcaattttataacatgataacttagaatcagctgggctaatcaaaacattatcatcagctaaaaaagggcgttttccatcaactattttacgagtaaaaaagtcattataactcttaaactctctttgttcatactgcgacatatctattttattttctttaataaacggtgcaattcttcgttttgataaactagaattcatataccagccacctaaatcactaacaaacttgcatacaaggatttttaaagcacatctaccaagaaatgtgccataaagtttctttaataagttattttggccctcaccgttagtttgaacattccctaaacgatcaacgactatcattttgtcaccacgatttgaatcaactctacaataactaatacccctaaagccgctaagccttttgactgtactttaggaactttaaaatcaacaataaataaaatccctgtaatcaacatcaaagcaccataaagataatccaactgaaaaataacatatcgcaaagcatatgccatcggcaaaataaatgatgatgttgtcactggcaagccttgataatactttctcttttctgttgtttctttttgtcttgtctcttctttaacattaaaatatgcaagtctaataaccgcagctagaacataaaatatctctattgctagccatccaattgaacttaatccaacattataccctaaaatagccggaaaaactccaaacgccactaaatcacataaagaatctatctggattccaaaacgcttttcttcatctgtacgatttttcttactacgtgctaccataccatcaaaagtatcacaaataccacacataattaagcaaataaatgcccattgatacatcccattaaaagataaatgaatccctgccattgcaaatatcaatgacaaatatgtaagaataaccgtataactataataaccgatcatttttctactccctaataaaattttcaacaaaaacagtatagcacatatttaactaataaggtacattaatctatcttttgtctcttaataaatctaaatttatttgattaattgatataaaataaagcaattgagcagttcgctaattaaacatattttttaattattctaaccaatttttaattgccctatcaatcttgcacctcttaatatttagttacttctatgcattatatcaaaattttctttttaaacaatctttattattatgagttataatttttatactatagatttagtctcatttccaaacttttcctatatatttatgaagtgattttatttatattattataaaagaaaaaataggtaaactgatgaatgatatgctcccttctaagtagacaagtaaattaatgacttgtcacctaggagggagcagttcagaacaactctttacctgctttttatctagatgtgtttatttagttttagttaaaatcaatatttagtgtttggcctaacataacatccttattaatatccgaatttaagcgagcatccggtttatttaaaaagattactgaggtagttgaatcgtaatgtttactaatttcatttaaatcaaatgctagcaggacatcacctttattaacttttgcgccttgttttaccattgcttcaaaatactttccccctaattccacagtatcaatacctacatgaattaaaagctctactcctgattccgatgtgattccgattgcatgattagttggaaatactgcgtttactgtaccattaaacggtgcaataacttttccttctgccggaataattgcaaacccctttcccattacttcctttgaaaaagtttcatcattaacatcacttagtgaaattaattttcctgctattggagaaattataccatttgtttcaacaatctcgtctttttcagttttcacaagaagtattgcaataacaaaagacgatataatactaatcaagaaagcaataattacatttgtaacatttacctgtaaataaattggtaaactaacaatactactagaagcaaatgctggcagttcaaaaccggtcatcgaaataaatgcaccacccagtgctccacctaaacaagctgatattaatgcttttctattgtggataagaactgtatataaagctggttctgtgattcctaagatagctgatatacttgcagaagttctaattgttcttttttctttatttcttgttttaaaaatcattgcggcaactgcaccaaattgacccattgtagacatcatcattgtaggaagcaagaaatctcctccgcgttctgccaaattttgaaaaataacaggggtaaatgcctgatgcatacctgtaattactaacaatggtctaatgaatgataagataaatcccccaataaagcgattaaatgtaaatagtcctcccacacaatatgaaataagtacaccaacatagttacctagaggccctaacacaaccagcattaatggaaccataattaaaagtgaaattgttggagtaaaaattacttttagtgcatttggcattattttatctacataacgatatatataagataaaatccatactgacaaaattaccggtacaactgaactagcataattaatcaaaggtactggtaaaccaaagaatgataatgatgcttctgtatcagcaacaagagttgtaaaagtcggatgaatgagagtagctgctaatacaattgaaatcattcgattcgtattaaaaatctttgatgctgatgctgccaacaagattggtaagaaataaaatgcaacatctgccatcatattaaatacgataaagacaccattatcttgaggaataatctcaaatgctttaattaatgcaatgattgctttcaacataccagcactagcaattgcaggaataactggcacaaatacacttgataatatatttaaaaagcttttgacaattccttgtttctctttttcttctaaattatctgcttcagaaaaattgaaatctttttcaatcgtctgataaatttcacttacctgtggtccaattactacctgtaattgttcatttttaaactgcacttttaatacatcttttaaagcctctagtttttcaatttctactttagtattatcttttaaattcatgcgtaagcgagtcatacagtgcatgatattttttacattatctttaccacctacatacgcaatgatttgttttcctaattctgtataagtcatgatcattccccctgattattttcttttaaaatatttccatttgatttaataaactctttcatccagtaaaatgatgctttgggatatctctttttagagccatttcctttatcgtccatatccacatagacccagccataacgttttttcatctcaccagtgcttagtgatactagatcgatgcctccccacatggtatatcctaaaactggtaccctatcaatttctaccgccttttttatttctaagaaatggtcatttagataattgattctatatgtatcgtttacaaaattattttcatccggtttatcgacttcgcccaaaccattttcgacaataaaaattggtttttgataacgatcatacacttcatttaacacatatcgtatactaactggatcaataggccatccccagggtgtagattttaaatatggattttcaccgaatggtaatgcgatgattcctaatttatcgtctttcccaatcgttgttgatctataacagctaaatgaataaaagtctaaggttccttcttttaagatttcttcatcattttcttccattcttatagtcaccttatattcatcccagaaacttcgtgcaaagcttggataataacctctaagcattacatctgaaaaatagaatagtcttctcctttgtttcatccatgcaagttgatcatcaggatgacacgttttaggatacgatggactagttgcatacattgctcctaacattgcttttggcataattttttttgctaaaattttagccctggcactggcgataaacaaatgatgaattgcctgccaagtagtttgagcatctgaatttcttgtacccagatgcgagaatccttgaagtacattaagttcattaaacgtaagccagtatttgacttttcctttaaacctttcaaataacgcattacataacttttcatacaaatcaatcattattcgattagaccagccatcatatttattagcaagatataaaggaagctcatcatggcaaattgtaatcattggttcaatattgtattttaaacattcatcaatgacatcttcataaaactgtaaaccttcttcattcggagttttttcctcaccagtaggataaattcttgtccagcagattccaaatctcatcattgataatcccatttctgctaataacttaatatcctctttatagtgatgataaaaatcaaccgcattatgactaggataataaacatgatcgtgaatacaccctactgcaccttctggaaatgattctctatatgcaactgaacctaacgttccatccggcaatctgtatgtaagccttctaggggttgtgtacgaaccatcagtcacaatgtcatgtgtaatgagtcctctttttccttcattaaatccaccttcatattgaaagtctgcactggcacttccccaatacattttaaatggataattcatattttgtcctcctgtacctgtcttatcacactgttagtataataaaaaaaatcacttaatctgtgatttttcacaagctggcacactgtttcaaaacatgaaacaaaagcttacctttaataactatttgtcatttattaaaaaagagataagaatatgttgatcaagtccttagctattgagcgcttgatcgtcatactattatatcctcactctcttttaaaagacttatattttcttagactattccactgattctcatatgaacaggaaaataaaatcaaggcttttaagccttggattttgttatttatgaaacacatttaactactcttgcttaaatctcttactttatcatcaataataattatcagtatattttttatgataaataagcgaaataagattagaatacatctctaatataacggacgatgaataactaaattcttcagataattcaatatatttatgaacaaaaggaaaatgttttaacttatttgcagttatcatatatattttaggaccaatttctctatccataacactcaaacgatccagcactctttctaaaaatcttcccccggcactaaaaataataatcagattttgatcatctaaagtctccagcatttctctttgttcatttggatcctgtgttgaataaatgaatttatgtaaaatcgttaaataatattgaagggaaatagccggaaaactagattgaacatgtcccattaaaactactctcttatagtcatgaatatctttaactaactcttcgagagtgtccgtatccatattttgatttaaataattaattatttctttagaacgttcgaaatagttcacaacataatctttggttgtaacaccatcaatatgagaaaatctttctgcaataaatgagttatatgttgcaatcgcatattgaagctccataaaatcctcatacccgattttacgacagaagcggctaattgaagactttgatacattacaattatcagctaattctttagtagtaattacctttcgcctatcaagattttctaaaatatactgtgcgataataaaattcattgaatctgatgattctctattgattacatttaataattgaatccttatattactcataaaatatcccttaacctttccttatattataagatatcttgattctaattactagaaagaaaaatttgagtttcattttttcttgaaatcatctatttaaatatctcgtagatatgtcttcaacacttaaaaatattacttatgtaaaaaaggtatgatatggtcatacctctttatcatttttataataacggctatcttgatataaaataacctcatcattagctaatgatttttttacatctattaatcgttgatttgaggatccacggaatcttaatttacgatccttcaatgcttcaacaaacggtccatcaattaaaacatctaaatatgataaaatctcaacatcaaaatctttgatttcttcatataagaaagaagaatataaccagattgtcttattaggacattgttccttaagatgttttaataaaatggaaacatcctggcgattttccaactctaatggttcaccaccaagaatcgtgattcctacgatatgcggctgatttactaatttaattaaaatattttcagtttttaaatcaaatttattcccgccagtaaaatcccaagtttcgggattaaaacagtttggacaatgtcgtttacaaccttgaacatataaagataccctaattccttctccgttagcaatatccgtttttcgaatttgagcatatctcatcgttactcaccataaagatgattatctaagtgaacaaaacgttcagcaatttcttgtgttctaccttgattccagaaattatcacctaaataaccacaagtacgacgacaaacatttaaagttttatgattacgatttccacaatttggacaataccattcccgattttcatctagtaagatttcgccgtcaaatccgcattcctgacaataatctgattttgtattaatctctgcatattgaattgtgttatacatatagtcaatcaacgctgataaagcatctaaattttctgacatattagtgacttcaacataactgattgctccgccagaagatactttttggaattttgcttcaacttgcagtttatcaaaagcatcaatatgttctttaacattaacatgatatgaatttgttaaataatccttatcagtaattccttcaacaattccaaaacgtttctttaatgctctagcgaatgtatatgtagttgattctgctggagttccatataaaccaaaacctaatcctgtttcttctttccagctgtcacaagcacttcttaaacgttccatgatctttgttgctaactcatttccttctttagaagtatgagtttgaccaattaaagctacaacacattcatataaaccaatataccctaaggaaatcgttgaatacccattttccaaaagcttatcaattggttcccctgactctaaacgagctaaagctccataacgccaatgaatcgggctaacatctgctagtgttccttttaaactttcatgacgtaacatcaaggcctctttacataattctaaacgttcatctaagattttccaaaagttatctaatttatgattagctgacagaccagcatcagcaagattcaatgtcactactccttgattaaaacgaccataccacttgtattcaccattttcatctttccatggtgataagaaactacggcatcccatgcaagggaatacttgtccctcatagttttcacgcatgatcttagcagaaataaaatcgggcatcattctctttgagacacatttaactgctaaatccgttaaataacgatacttactatcttgcggtacattattatcatcaagaacatataaaagttttgggaaagctggtgtcacataagccccaacaggatttttcattccaataaatcgttgttttaatgtttcttcaatcagcattgctgtttcttcaatatattcaggttcttctcttaaatacataaacactgataaaaatggtgcttgtccattagtagttgagaaagtattaatttgatattgaatcgtttgaattccggctttaatttcatcttgtaggcgtgatttagcaatcttaataatttgttcttcactatagtcaattccaatcaaacgaccttcattacgaacatttcgttggtgcttctcataacttaaacgcacatatggtgataaatgagctaatgagatagtttgtccaccatattgaccattagctacttgttgtacgatttgagttgccacagtacaagctgtttgtaatgatttaggtgtttcaatcaacttatcattaataactgttcctttagcaaacatatcctttaaattgacaagatcgcaattatgcattttttggatatagtaatccatatcatggaaatgaatgattccatcatcatgtgcctgaacaattttaggtggtaataatagccgccgacaataatcttttgaaaattcaccagcaatcaaatctctttgagttgctaaaactgtagcatctttatttgaattttcttccattgcttctttattagtttggtttacaattccatatatctctttgtcaatcgtatttgtttctctttgaaactcccgaactttacgatatccttcatatgctttagcagttaagatttgtcctttttcaattaatttttcaaaaacttgtccctcaattcgatatatcgaaatattattatcactgaattgatgccagttttctatctctacagcaatatcatgagcacatttagaatcaacgatcccgcttccgcactgcattgcttttaaaattgctttttcaatttttgaagcatcaaactcaacgctttgcccatctcttttaataactttcattctgttccctcctaaaaatctcttttattatgttaacactaaaactttttttataaaaataatacgcatcatcacctcattaaaatattcaattggcaatgcacacaaatattaattataactgatatttatattaatttctctagtttttttcaattttagaaaattagtaaattatctattttgatacatctagtactatcatcatctaacaaaaataattgctattttcctaaaatatcaacaaaaaatatttgtttactactaatagagcattttacttttcaagtcgataattctctaatatactaatttacgaaacttattatggaggacaaaagaatgtacgtaatcaagaaagataatactaaagagctttttaatatacaaaaagttgtaacagcaatcaataaatctgcgacacgctgtttatataaattcaaagaaggtgaagaagcacaaatttgtgattttgttgaagcccgagttaaagatttcaatagcaatgaaattactatctctcaaatgcacaatgttgttgaaggtgctttagatgcaatcaaccctaaagtagcaaaaagctatcgtgattaccggaactacaaacaagacttcgtggcaatgttagatgaggtctataaaaaatcacaatcaatcatgtatattggagataaagaaaacagtaatactgatagtgctttagtatcgaccaaacgaagtttgatttttaatgaattaaataaagagttatataaaaaattcttccttacgactgaagaactacaagctattcgtgatggttatatctatattcatgatatgtctgcccgccgtgatacaatgaactgctgcctttttgatgttaaaagcgttcttgaaggtggatttgaaatgggaaatctttggtataatgaacctaaaactctagacgtagctttcgatgtaattggtgacattactttatcagcagctagtcaacaatatggtggttttactgttcctagcgttgatttattattagaaccatatgccatcaagacttttgatttattttatgaaaaatatctaagtttaggattagatccagaaactgcttcaaaagtagctgagggtgatgttttaaatgaatttagacaagggttccaaggatgggaatataaatttaattcagtttcatccagccgaggtgactacccttttattacaatgacgacaggaacaggaactggcaaatttgcgaaaatggcttcaattgaaatgcttcatgttcgtcgacgtggacaaggaaaaaaaggaaataaaaaaccggttttatttcctaagattgttttcttatatgatgaagaactccatggcgagggtaaagaacttgaagaattatttgaagcagcagtattatgttcaagcaaaacaatgtatcctgactggctcagcttatcaggtgaaggatatgtagcttcaatctacaaaaaatatggagaaatcatctctccaatgggatgccgggcctttttatcaccttggtatcgtcgaggaggaatgcatcctgctgatgaaaatgatactcccgtatttgtaggacgctttaatattggagcgatcagtctccacttgcctcttatttatgctaaagcaaaacaagaaagtaaacctttctttgatgtattagattattatttaaacttaattagaaagttacatttacgaacatatgattatcttggtgagatgaaagcctctgttaatcctcttgcttattgtgaaggaggcttctatggtgggcatcttggtctacatgataaaatcaaacctattttaaaatctgctactgcttcttttggaataactgctttaaatgaattagaacagttagcacataaaaaatcattagttgaagatggttcatttgctttaaaaacaatggaacatattaatcaaatggttgaaaaattcaaagaggaagatggtcgtttatatgctatttatgggaccccagcagaaaacctctgtggtcttcaagtgcaacaattccgaaaaaaacatggtgtaattgaaaacgttagtgaccgtgattatgtcagcaactctttccattgtcatgtttctgaagaaattagtcctattgaaaaacaagataaagaaaaacgtttttgggacttatgtaatggcggtaagattcaatatgtcaaatatccaatcgattacaacatgcaagcttttaaaaccttacttaaacgtgcaatgagattaggcttttatgaaggtgtaaatctatcattatcctattgcgatgattgtggccatgaagaattaaatatggatgtttgcccaaaatgtggaagtaaaaacttaacaaagatagatcggatgaacggttatttatcatattcacgagttaaaggggatacgcgtttaaatgatgcaaaaatggcagaaattgcagatcggaaatcaatgtaatgaattatcataatataacaaaagatgatatgttaaatggtgaagggctccgagtagttctttggctttcaggatgtacccatcgatgtccgggatgtcacaaccctcaaacatgggatgtcactagcggtattccttttgatgctgaagctaaagctgaaatctttacagaacttgataaagattacatttctggaattactttcagtggtggtgatccgctccacccttcctcaattaatgaagttggtcaattgattaaagaaattaaagaacgttatcctgataaaacaatttggctatataccggtttccaatttgatgatattaaaacgattgattttatcaaaaatattgatgtaatcgttgatgggcgctttgaaattacccaattagatcctcaattacattggaaaggttctgcaaatcaacgtgtaattgcagtaggcccaacacttgcttttaatacaattattcttcatgacgataactaggatggccatagccaccctagtttttatatataatacaaatcctgacctaatgcttttaatgcactttcatccgtaatcaagtaattgcctcgtttaaccttacaaagatacccacactgacaaaagtcatttaagactcgctgtaactgacgataactgcacccgatcatttctgctacttgaacaaaattatccttgatgatcaattgttgagcactcgaaataagatatgaagctaaacgattttcaactggataattaattgaaatagcagtattatgattagcatgatatagccgatttgaaagtgttcgtgctaaataacgcataaatattaaatcatgtaataaaatatcttcatattgcgccactgatattctaaaacaaactgtatttttgagtgcgtaaacatcattagtgacttcatgatgatttagaaattcaacttctccagtaactgtgattggattagaaaaagctgataaaactgttgttccattcgcagtcgttcgacagcttttaattcttccagatacaagaatatataaatattctaatgtctgcccttgatgtaatagatgttcagccttagaaaactcacataattcaagatactgataattatcatcactcatcatctgctcaactttaagcaaattgatataatactctcgatttttcatatatatcaccaccttaaatatgacatatgtcgtatttaaaagcaatatcttttctttataataaatttggaggtgttaactatgtatttattattatcttttttatgtggtttaatcgtatcgaccatgaatatttttaatggtcaactatctgcccactgtggtgcttatctagcaaccgttattattcatttgattggtttaattacttttaccttgatcatgtttttaaaaaagcaagaaatctcctttaaacatcatttaccctttattttatacactggcggagtaattggtgtactaactgtaatttttaatattatcgctgtcaataatattggtgcagctttgttaacagcattaggcttactgggtcaaatgattatttctatcatcctagaatctaaaggctggctagggtcattaaaaagaaaactaacaccacttaaatggttaagtttaataattgtcacaattggaattggagtgatggttaaataattgcaataatatgtgcaatagctagcggtatgactattgttttaagccgttccataaatggatatttagcaaaaaaaatcggtccttatcaaagcactttctttaattactttactggtttgcttactagttcaattctcttattttttaccctgttaccagcattcaaaaacatttcatttacaaagatagatctaataatgttagttggaggaataattggtgtctttaatgttctaattttaaacatcgtcatttccaaagttactccaatcaagctaactctaattacttttatctctcaattacttagtggaatgatactagactattatatctatcacgtcttcacccttaacaaattgattggttgtattatcgtcattattggattaattatatatcaatctgctgatataaaagtcatttcaaatgaagaaattaattctatctaataattttcctaattattttagattgtcgttgacaatctttttcatgattttattcaaatattctaacttagctttttcatatatctaacacatttgtaaaaaacagaccattactatattgagatcataaaatcctcataatttccttataaaaaattcaaaatgataactacaagtaataacataccgttcgcttatattttcctttgtacttaattctcctataaattaaatagctatctctttttatcatttctctcacctcatatagtatattttgtaaagataagcaaaaaaattaaaataataatttcttatttaaataacgaatataaatgacacacatgataatcgatgccatagaagcaataggtgatgcaatccccatatgaaataaagtaattccgctcaatttactaattactaaagttaatggaattcttaaaataaaggttgccagcaaactatgaagcatcgtaaaaacagtatatccaccaccatttaaataaccattataacaaaagataaaacttgtacataaacaatcaaaagaatatgtttgtaaatataaagccgcatttttaattactgcctggtcactagaaaaaattcgtgtgaaaatacttccatcaaattgacaaacaattgtcacaatcaatgaaatcgaaagacaaaaagcaatcccataacgcattgatttatacgctcgtgaatactgctcggccccaaaattttgagctgtcatcgttgcaacagcattacctaaggcaattgctggtaacattaaaaattcaatcaatttttcaacaactccaacagaagcactagcaactaaccccataccattgacgattaccgtaatcaacaaaaaagaaataccaactaaagcactttgcaagccgattggtaacccaacttttgtgattttcgcaatcatcggaagattaaaactaatatcttggcgattaaacttaaaacctaatcctttatattttagatagatcaatgaaaaaataaaagctcctgcttgtgctaataccgttgcaatagcagctcccactgctcccatttgatagctatctaccaaaataaaatctacaataacatttattacacacgcaattgcaacaaataaaagaggtgtcttactatcacctaaacctcttaaaatagcactaactgcattatatcctacaataaaaacagttcctaaactacaaatatataaataacttctagttgcactgattgcatcgttaggtgtatgcattaatcctacaatctgatgattagtcaaaaataatataattgaaatagtcacagcaatcatagtaaacaacacaactgaagaacccactgttgcagctaattctttttcctttttagctccaaaaaattgtcctaataatactgtgatccctgttgtaaacccaaggatcaggttagttagcatcgccattgtttgactaccgatagaaactgctgaaacatcacttgttgtagcgaaatgccccaccacaaataaatcagcagctccgtataatacttgtaataagtttgataacatgaagggaattgcaaagagcatcaaacttttaaaaacacttccatttaataattcatcattcatattttcctcctaaaaaaagctggataaaatagtggtttgacccactaccttatccagcataatttcttataccctccggtaagcaagaaaattttaccaagtttgcccttaactgtcaaactttttatttatttagtttctcttaagcaatattaagaaaggtttaattttattaattgaataaagtggtacaattcaagtatgaagaaactactaataatctgtttagtcctcctaacaggatgtactaacgcaaacgcaaaagtaaataaaatcgaacatcaagatatttttgatcaagtccaattaagtgattatcaaaatgttatgatcgtagctcatcctgatgatgaaactatttggggtggaatgcatttactaaaagataaatacttggttgtctgcctaactaatggtgataacgaaatacgttctaaagaatttaaagaggtgatgaaaaaaacacagaataccggacttattttaaattatcctgataaaacaaatggtaagcgggataattggaaatcatcatatcaaaaaattgaagacgatttaaattatcttttatcgaaacaacattttaatctcgttgttactcacaatcctaaaggtgaatacggccatcagcatcacaagatgacaagtgcaattgttacaagtattgctaaagatctagcaattactaataatttaaaatattttggtctttattatcgaaaaactaaccctatcttgccaatgaaaccaacctttgatgatgatcttaccaaacaaaaattagaattagcagattgttactcctctcaaaagaaagtctgccataacttaggacatatgttcccatatgaaaactggatcagctacgatgagtggcattgatccagttttttatctaatctttgttttatcaatcaaacgatagtaatctaactttcgttcaagattctcttcataatttaattcaaaatggaatgaggaaaatgctgataattgtccatatattagccaaagcgaagttcaaacaattttcgctggaaatatacaataaaaccaacattagttggttttattgtattaacaaagattttacattatacacattcataaaatcccccaccccttatcttaccgctatattctatactataaataacggggcatagcagaataagattttgatgataattctttatcatcaaatttagttctaaaaacttatcctccgattttttcagtatagaattgttctttattcaccttgacaaaaaaaagcacataatgtgcttttttagctcaatgtaccatttatactgcagcttaatgtgacaactgctgtcttagtgtatataactactccattttgatatttattagctgttgctttaccaattgccttatttccactttttgaagacgattttgaagaaatcctccatgcagtcccaggacatgtagttgatactgatgaactggtacatttggcagaacttccattataggtaaatgttcctttaactgataccgaccacataattttcccattactgtaataattagaagtctttgtacctgtcttggttcctgccgcctttacccgtgtatcttcagctatagtcgtaacaagataatctccattttctaaatattctgtttcgatattaatttctgcagcacttactggcgtgtatgttagtataactcccaaaaaaagaaaaagtgacaataatatttttttcatcttctactcctccgtaataattgtttcttctgtgataacagattcacaataatcaatattttgctctttagattctttataaccgatataaaataaataactataccacaatgctatacataaagctaaaacagtaagtataattaaaactctagatataatagtgcgaagccgtaattttctgataagataattctcatcacagctgtttaaatacgagattactacatcttttggttctccaaattccttaataataccatgatatgatacttctggagtttcatctgaaaattctgataagttttgtttaaatccattcaaatactttttctcgttttttccttttattggaagtaaagttttaacatttttatagtatctggttatgtctttattttttttcattttaatgccctaacaatgattaatgatattttcaattccgttaatcatttccctatattcattaattagattttgtagtttttcaagaccagatggttctagatgataataaacacgaagtttcttattagcaatttcctcatacgaactaacaatcccttcttcttgtagtttgcaaagaatgggatacatagttccagatttaatatcaagtaaattgtcggaatattctttaataagctttgttatctcataaccataacagtcttgtttctttaaaatgcaaagcaacagcatttcaattttaaataaattatttttactgctcaatataatcacccttaacgtcaagttaattacattatactacacatgcaatttttatcaataagtagattttctatatatatatatattaattgacaactataaataataatgataatatatatttaaggaagcgctttctaaaaaatatattggtgggagaaaataaaatgaagaaaaattacaaaaggattactattatactgactgctgttataatctttttaggcagttcggtttctattaatgcgcaagagaacattacaatttataattcaacaatgggagaggtaatgcgacattttgaacctgctgcctattcagaactacccattgaaatcaaggaatattatgattcaattggtgcatataaaattttaggtgaaaatgctgatgaagtattaccggaatcgaggggggtaatttgggttcctagtgcaatagtattaactactgtatataaaaatagaccaagtagtgcgaaaataacttttggtggtaattatagttgcactaaaggcgttaaaattaatggtttcgcatatgtaatagaaagctcaaatggaaatattgtcgaatccggaagtgtaagtaaaaccaagtccacttctgcttctttaagaaaaaccgtttcaagaaagaatacagggaagaaatattattgtagagcaattggtcactatatggactatgatactggcttaactaaaacaacaatgcaaacatcaggaaattttagttagaaagggggactcaatttgacaaatagtggattaggaattatgtgggggcctgtctcaattgacgaaaatgcaatattgatagttgtactattagctttattgataattggcacattaatttattataaaagaaagaaataaaattgatatatctcaagctaaataagagtagataaaaaagctatgtttgatatgttagagtttaaatctcataacttttattcaagaattagagagttgttcaaaaagttggctatggcctcatggatagagttcggcgatgacgaaatattcgtgacgagtttctaaatgaaaaatttagataatcctcgtggtgtattagcaaataaataacaagaaaacgttttcgatttatttgttaatactctttataatttaaaaaactatgaaatgcagaacaaaaaaatgaagaaaataattgcttttatactggtatttacattaagttttggtgcagtaacaaatgttagtgcgttaaacaatagcgtagtatattcatactcttataaagactatgaaaccacaattcttaattctaccaatgaatataatatctgttttgaaatagtagagaatggtgctaaaaataaaattagagtatgatacagactttagatatataaaagtaaataataattattacaattttaatgattgtaataatgcgttattattacaatccacatatatatacgacaaaaatcaacctattacaattgttgaagcgttaactaatttttcaaagattgataatataaatgatttaaatagcaacaagatttcagtaaaaaataataactcgttagtaccaaaagcagagtatggtaagttttattttgttggaagtaggaagaagagtatgctagtatctttagcaagtagcgcaatatctacaataattgcattcttagtaactggtgccttaggacttagtgtgacaaaggcaaatgttgtttcattcatatcaggagtattatcctctgaaggggttaattattttacttctgatgtatattataaggtttatcaagctattttaaatgctcataatacaacaagagaaaaaagaattttaggtgtcttccaaccttttaaagcacaagttgtgtgggatgatgcacacccttattacagaacgtttgaaacacagagaccaaacagttaaacataatatttcaacattgtgaaaggaaatacaaaaatgaagtgtccatattgtggaaaagaaatggataaaggattttttaattcagcaaaatgggattatacatggaccccggaaggtaaaaaaccccatttttggagaaatcacccaaaagaatatgaagttcttttaaaaaaaggatggaatatactacaattaacagcatatagatgtgcggattgtagagttataattataaatgaagatgattgttagtataaattccattatgctaaaatcgaatcgttggtgttctaccttatcgtttcagaattaaaaaattactattgaatacaaaaaagttcgtaatgtattttacgaacttttttttaccaatgtccttcagtcaaactgctgaaccgttagaaatgatgaaaatgataaattaacttttaaaaagtatagtaatcgagagttttttaacattcgcgaaaatacaaaaggctatatatatcaatggtttaaagtgaaaaaaactattgcaagctaggttccaggcttgcaattatgtattattttttatcaaaattttggcaaaatactcccacctctacaggtggtgagataaacgccgatttatttcactaaaattatagcttttataaaaaatagttaatttagggtttgattaactacattttaatgttgttttgatgattttgaagtgctgaaaacaatacaccataatcgtacattttaaaactcaaataactaaggatatcaaaaaagctagaaataatacattcaatatcttcgtcttcttgaacacccagtcttttacatatacgttgatttgctttataaatctcttgatatactaaagcacatctacttccttctacaaattcattttttactaccttactctctttttggggatagtttctaaatcagtatcccctgtcattaagtcatatactaattctttaaatttttcactttttatatccattatttacactcctttacttttgaataaatagtgttcgtatattctttctcccgacagtaaacgttcttcccatgaattctcctctacactgcttgaaaagtcaggatatgaatcgcatgatgtttatagagctttatcctgcctggctgaggaatcaagctacattcaatccaaactatataaaaacactcatttcatcaagaaaagaaataccaacacactttattatgactgcaccaattactattttgagattgaagaagatggtgactttagaaaatatggaaaaagcaacgagaatcgacctaatccaattatagacatgggacttatgatggatggtgatggtatacccgttagcttttgatctctatgaaggaaacaagaatgaacagatgacattaaggcctcttgaagaaagacttatcgttacatattcactaaaatatgcaatctatcaaaagaaaatcagagaagaagaaatgtatgatggattctataccagcactacaaatcttgaagatgatgatatcaaatcaataatcgaagtatcagaaagaagatgtcagatagaagaatggtttagaatcatgaaaacagatttcaagacaagaccagtatatctgcataacaaagatagaatcaaggcatattttctaacatgcttcattttgctaattatctacagacttttagcgtataagttgaataacagatatgcagtaagtgaaacattaaaaacactaagagaaatggaattagtagatacatagtataatggaaatatactagcatacaggagaacccaaacaacagatgagcttcatcaattatttggattcagaacagattattaaataattggaaagaaaaaaatgagaaatatcataaaaaatacaaaaatcgtataagttacgcatattcgatacaaaggataaagtggtacaattcaagtatgaagaaactactaataatctgtttagtcctcctaacaggatatactaacgcaaacgtaaaagtaaataaaatcgaacatcaagatatttttgatcaaatccaattaagtgattatcaaaacgttatgatcgtagctcatcctgatgatgaaactatttggggtggaatgcatctactaaaagataaatgcttagttgtctgcctaactaatggtgataacgaaatacgttctaaagaatttaaagaggtgataaaaaagggacaaaataaattttgtccacggggtgattaatcactacagatgattatcacctttttttgttttataatatacctggtgatatataatgattgatttagctgttcctgttgatacctcaagtcttcttaactttagtcagtacgttcaaaatgccggtaaagaaacttttagatatatcttttttgacaactttgattatatttccaaactacataactccggtaaaatgcgcgatgttatctttgacaatattcaaaaaactattttatgctcttctatctatctgggttatgatctttatgagtgtccctactgtggccaggagactatcgtcgctcatacctgctcttccagattctgctccaaatgcggttctaaagcttcccagcggcgcgctgcttttgtttctgctatggctttcgaatctaagcatcgtcacattgttttcactattcctaaagagcttaggtggttctttctaagggatcgtactcttcttgacggcttttttgtagttgctcgcaatgtccttgcctgtgtattcaatgaccgcaaataccgtaaagaaaaatccagacataaaaatgatcttatgtataaacatcctaaacataaatcaaaatacctcaggaaaagaaaaaagccgccagataatggagtatacggaagaagagcttgaagcgttaatagaggatgaagtactgattgaaatgaaatgtgaatcgtgcggatatgaagaaggagtaccggactggatattagaagaatttttaggaatggaactaagcagcggatccaaagacaggagatacagctgccagtgtcccaactgtaataaaacaatgttcaggaaagagtaattttctgacacttttttgggtaccataaatcaggtacccttttagttggaatgatatactgttattatcagacgaatccaaattcctatagaataaaaaagagaagatactgctaccttcccctgaattcctaatctatatcttaataataatgacgttcaaatgtagcatatttcttatttaaaatgatatatgcaacaatcaagataattccagcaccagcacaaatagcaccatctaaacgtaaactccctaccggaatatcaatgctcattcctaatagacgatttccaatagtaaactccattgcactaacaactaatggcataaataaaccaactacaatacctgaaataacagcagcgattccactaaataaagtccatttataaaatgatttattaatcaaaccaagtaaaactgctgttaaaataattcccaccacacaaataattctcgttggagtatcacttaaagttttataagttttaataaatttttgtgttcctggtgttgttttttggaccttttcaacggtacttacaattttattttgtaaggcaccattttcatcagtaatcttactttgaatttgttcacgctgctctgtagtgatttttttaccaattgcttcttcgattgcaggaatattttcatcaacagctttagataattgtgcagcaatcgcagcagtatcaacatcactaccatttgctacagctgctgtaatttgatctaataaatcgctcgtcacatcatttaaagcactattattttttactgcttcctcaactttcttgatattttcattacttacatcaggaaatgcttgattaagtacttcttcaatcccgttacttgcctcttgaacaacgacagcatttgtaattgctttagttgacattgtcttaattgatagattaacacataggagcataatcaaacataacatgacaattgttaatactacatttccaaatttcttcatttctttctcctcaataagatgccttgttccaatttctaaactataagatatcttttctaatgtatttattatagttttttttatctcttaagtcaaaaagagtgccaaatcacactctaattataccgttttctgcggtttgtatctttaacaatataaattggtcgagctttattttccatataatctttagacacatattctcctaatattgcaattaataacatttgtgttccacttaaaaataaaattaaacagacaatcgtagtatatccacctacgctatttccaaacatcaatgttgaaatcgctgtatataacgataaaataattgaaccaacaaataggataacaccaaatattcctgctatctttagtggagcagtagaaaatgagaaaattccttctaaagcataagaaaataagcttttaaaattccatttagtagaaccagcagccctttctacattattaaatggtaaccactttgtctcaaaaccaacatatgaaaataaacctttcatataacgattatactctctaatttctaaaattgaatcaaccataagacgactcatcattctaaaatctcctgcgccatcactcatatccaattttgataatttttgcatcaccttataaaatgacttacttaagaaatttcttaatctaccttcaccctcacgatccattctttttcccgcacaacaatcgtaaccttcttgacttactgcctgatacatcggtgccagcaattttgggggatgttgaagatctgcatccatgattacacaataatcaccggttgatttttccaagccagcgaacatcgctgcttcttttccaaagttgcgagaaaatgaataatagtcacaatggtgatctttagcacagatcatctttaataaatcaattgtatgatcatgactaccatcatcaataaataagatttcataatcaatattttcaatcgtttcaagttctttagtcacttccttatggaataatggaagtacttcctcttcattataacaaggtacgattacactaattttgtccatattcatgtcctcctttggcagcaaaaatcttaaacttgcatagcccataatttgaaactactgtaattacactaactactacttttgataacatctcatttgcagataataactgaataaaaataaataataatccgctttcaactaataatgtccctaatcttaaaataaagaattgataagcttcttttccagtttcattagcacttttaaaaacaaaatgtttattagcccaaaaagcgaagataacagcaccaacccaagagattacatttgcaaaaagccagccctgatccatcattgtaatcacaaaccaataaattacaaagttaattagcgttgtgcatccacctacaaatacataactaattaattctttcaaatcctttttcattctttttccttctcccttgaaatactaaccatataaaacccacaccactacaaacataaccaacatttttcattggagctttaaatataattctaatctggtgttgtcctttagaaatctttgctcctaaaaatgctttatttacacactccttagcaacttctttgccatcaattaataccgtatagccattttgatacggtaatgaagtaactaaatagccatcattactaacattgattgttccttctacaagattgccatcttgattatacgagccaactaatgcatcaatttcttgattacggtttttgattacatcatagtcaatcgtagaaacttttatattctttaaatcataacgtccattactgaaactaatactaagttggtcaagcaattcattttgacttaaaacatatgtaaaatgcgtattatgatttggataagcagcacttgaactagataacttattttttaccccattaatcgtaatactcgtatctttacgcttaattaatttaactttagctaaatcaaattccacaattaaaatcttattagttaaatcttgattgatccctaattctaatttacccgtctttttagtgttaatacgatagccatcatttaatttagttatttgtaaattatcgcttttttcttttacaactgtttctagtgcaaccgtagctgccttactttgataattactctgaccgcctgcaacaaccacattattataaatagtgtctaatgtttgtgggtaatctagacgatcaaactgcacaacatcatagctattactagttgcataaacaagcggcaatactttatcattttgatatagattattaccaattgcttgatatcccatcggtactacattttcactatagagcgtcttcactcccatcattccttgaaagaaaatatttgaatttgatagacaagcgacacgatttttaatactaataggatttttaataatatcgtaataaaaatgattatagagactattactaacggaactatagattgaacttctaagctcgttattactaacttgattgacagtgttcaatgactgtttaaaaatatcatatcgaccatctttttctactttaatattttttaaattcgaaacttgttgataagtgtcttttgtaacaaaactctctttttgattattaacatagctaattattaaaggcattaccaacaataaatataaagttcgttcagttattcttagatacaataatatcccaaccaaacaaattataatatctaaaataactaatggctctttataaaataagacaattggtaaaataagtagcacaattaattttaaatccaatttaatttgtgattgtttatactcattgattgtttgaattactacataaataatcaatggtgtaaaaggaagcaaaatcttggcccgaggatataaaaaaccatttaagacaaaactaaagatcgggataaataataacaataatagccagatcgataattttctcgtttcttttaattttaagcttagaactaaacctgcccatgcaacaaagcctaatccacagccataagcattatacaatagggctttaaaatcacctcgtggcactactaacgacatcaaatcaagtgagccgccactactttgatggttctccagcataacataggcagttggaattaaaagaattccacaaataagcactccgatcaataacggctgaataaataaacataactttttaaaagtaattaggtttttcaatcgatacatttcaaaacaataatatgtaaaaattgttagtaaagctgaaattgcaaaaaaataactatttgcaattattagaaccactgctccaattaataacccttgcttttgatttttaatatatgtatctaccgcgatcaatgccaaaagcactccaggcatataatcaacaaacatgatttggcggtgactttggaataatacagaagaagataataataatacagctccaactatacatagcgttgtgctaaactgtttgcgtttcaaccatatataggtcaggttaacacttaaaactaaatttattatcatataggtaattataatatctttcattgctattccaggaataagacagccaattaatacgtcaggtcgaaacaatccataataagatatattataaatattttgaccaccgccgatattaaatgcaaaatcggggaaaaatgattttgtctctaacatcgtcttccgaatataatcagctagattgacatgttgcgatagccaatcagtattagctccaaagatactagaagaaggcgtgatgactatgatcatcactaaggttaaacatgttaaaaatataattgggtaaaactgcttttttttcattactatcattctcctgctcacattatcgtatatattccttaagaatcacctaaagaacatctaaatatttcttaattttcattttactatcttcttaatttccattatgatgtataataaatacgaaagttggtgaatatatgacgaacaataaaattttaattgtcgatgacaatcctgaaattagagaagtattaaatgttttgctctcaagtgaaggttatgatgtgattgaggctaaagatggccaagaagcaattgatatggttagtgatgatatcgatttatatattctcgatattatgatgcctataatcaatggttaccaagcctgtgttgaaattagaaaaaaatctaacgccccaatcttatttttaacagcaaaaggtcaagaaagtgacaaaacacttggtttttctagtggtggggatgattatttatcaaaaccattctcttataatgaattaacgacaagagtgaaggcattgttgcgtcgatattatgtttatcaagggaaaatggaaaaagaagaaaataatgatgacaacattgtttacaataatattactattaatcctaatagtgaagcagtgtatctaaacggagaacaaattgaattaacttacctagaataccaaattctttatcttttattaagtaatcgtaaaagaattttttcaacgcaaacattgtatgagagtatttggaatgaaccttattattatagtgctaataacacaattatggttcatattcgaaatcttcgtaaaaaaatagagagtgatcctcaaaatccaaaaataattaaaacaatttggggtaagggttatcgttgtgattaaaaatttctttaataaattaagtattcaaattagtgccattatcattatttgtggaaccttaggggtggcaactttttgtctactttatgccggtaaagaaagtttctttgaatttacccaaaacttaggggtcatctctgaaaatactgaagcttatgcaaataatattgaaaatcaaattattgatcaaaatgtatcaattactgatgtcgatactctagataagatcttaggtactagcgatatttatagtgtcaatctatataataaggctgataaccttgccatcactggttcttttgctaccatgcttgacaattttatcatcggttcaacagtatatgatactgaagcaatttataacggtgacgattatagtacagaaattgagttaaaagatggaaccattgaaatgtatgtttactcatatgctttagctaaattagtcgttccttacatcgttgcctcaattgtcattgccttatttacctttttacttccaacctttttatttattcgacgtaaagtaaattatatgacaacattaaaaaatgaagttacaattatgtcacaaggtgatttagaccatacaatcaaaattaatagtaatgatgaaattgcagaattatctaatcaaattgataatcttcgcctaaccttaaaagacaactttgctactgaagaagctaatcgcaaagctaattatgaattagttacagcactttctcatgatttgcgaactcctttaacttctttaatgggatatttagatattattagactaaagaaatttaaaaatgaagatcaatataatttatatttgaaaaattcaattgataaagtaaatcaaattaatgaactagcaaataaaatgtttgaatactttctcgtctttagtaaagatcaagatactgaattatctaagatgtcactcggcgtaatttacgaatatattttagaaaatattggtgtcttagaagaaaatggttttgaagtaatcaaaaacattaagcattctgattactttattcgcggtaatattaatttagtcaaacgaattattaataatgttttttccaatgtcttaaaatacgcagatattaaacagcccgtttatatcactttattgatcgatgaagatattgaaaatctaggcttaacgattaaaaatacaaaaaaacatagtgctaactatattgaaagtaatcaaatcggtcttaaaagtgtccaacaaatgatcaagattcacgatggtacttttacagtccttgatgaagaaagtactttcacagtatcaattacaattcctttaatgcaataattagtgtataatgttgctataattttaattaaaaggagatattatgcaggcaatagcaaaatttcataaagtatctaaagaacaatttataattgatttcaaggacagttttcctaaatatgatgaggcagccattaatgatatatatgcttcaattaaattacctaagcgcgctactatcggttctgcgggttatgacttttatacccctatcgatttcattttaaaacctcatgaaacaattaaaattcctactggaattagagtttctatcaacgatgggtgggttcttgctatctttccaagaagcggacttggttttaaatatcgtttacaattaaacaatacagttggaatcattgatagtgattatttcaatagtgacaacgaaggtcatatttttattaaaataactaatgacagtaatgaagataaaacagttgaattaaaagctggccaaggttttggacaaggaatcttcctacaatacggtattgttgaagatgacaatacgactgatgaacgtaatggcggttttggttcaacaactaaataaaaaaatcagatggttgattatagtgaaccatctgatttttttataagttatttttattttcttgataatgttgtttaaatttaattgctattattaaacaaacaataattcctattaaaaatggaatcgccgaaaaaaaggcaacgtacggtggaaaactagtcgttttatgatgttcaatcaaacaatattgatatgccacaacaatacataataaatgtgataaaaataaagtcaaccccaaaaaactataatacatatactgataaaatttcatttcatccacctccatatgactttgttatgattcatttattccttcttttatcattataacatagtattttttatcaattcccatgattccctatttatttacaaaatctttagtaatatgttatcttttttgataatatattagtataggagggaattattatggatattttaatgaaatatgctaaaaagaaaactgtttttattttatcgacagttttgtcagggatagttacattattgtatttaatctcaaaattcggtccaacaacatcatctaatgttaatatcaatgatattaatgaattagctggaacgattggatcaatggttacaattattcaaattatattttatctatttattatattagccattgtaaccgccattcttagtggagtttattttttcaaaaaaaataagcaagaatacgtgatgctaggggaattcatcgtttcatgtatcaactcaatattattactattatcaatgtccggaatcaatgctatttgtaagattcttagagttgcaattagtggtgattattcatcacttatgactatgaattcagcacgattacttagttccgtaactagcgctgcaagcaaccttaaatattttatgtatttatcaatttttgtatttattatcaatattgttttattattaattgttaaaaaaattattaatattgatgggtttcattttaattttgatgaaccagttgtaactgctgttccagctcaagaacctgttcatgaagattctacaactgtcgaagacgattctacgatagctgataatgagttaacacaagaaaacggagaaactgaaactaacacggttgaacctaatgcttctgaaactaaaccggcaactatcaatacacaaaaaatcaaagacttctttaaaacaaaaaacggaaaaataacgattggtgttgctgctgctcttattgtttgctttggtggttataaaatatatgatacattctttaattatactagtattgatctaggtaaaaatattactgttgaatttaccgggaaagacggaagtggttatataaaagatgttgaaagcaatatcgattatgacaaaaataattctgatttatctaactttgttagcagcacttatactgactatgatttttctggagatctatctaatggtgataaaataactgtaacgattaaatactcagaagaattggctaaagcaaataaaatcaaagtaactaatgattctaaaacttttactgttaaaggtctaattgaaaaatttaaagatagcagtaaaataccagaaaaagttattactcaattaaaaaaagaagctgacaaaaacataaagaatcgctataaagatggttattcttttacttataatcatgaatttaattctctttggtttgccaaaggggaagatgatgataacgacagtgttattgctatatataaaattgacgaaacatatacctcatcattcagtggccaacaagatgttgaaacttactatgtcgcaatctatgtcgatgatgttgattctgcctatttagatgaaaagtcacattattggtatggggcttctttatatggcagtgatggtaaagaattatcagatctaaatgcattggaaactgctttaaaagaaaaatttgatgatcaaactttagaattaatcaaataaaaaactaaaaccactttttaaaatatttaagaagtggtttttttattccaaatcaaactgattattaaattattttcacttatcttagcagttacatctcagtaaattctttaacaatagctaatcctaagccagtattttgttttgtacgagaaatatcagaagtataaaactcatcgaatatttgttcaactatgattggctcatctaatcgatttttgaattgaaaacaaatttctgctcccgtattaatagaaatataaatatctccacggctatgcttcaaagcattaataattaaattatcaaaaattctccgtaagatccgttcattactaagcatctctatttttttattacctttaatatagatcatccgcccttgactattaaaatcttgataataacaaactaactcttcttcaaaaatacgattaatatctaataactttaattcaaatttttcttcattggaaatgattttagtaaaagtaaaaaaatcttctatcaattgcgatagccgttttaacttatcaataataattgattcatatttatgctgttcttctccacttagctcatatttttgcaacaattcgacatagcccaaggccgaagttaatggcgtttttaaatcatgagaaatatttacaattgttttttgcaaactattatttttcttttcaatatcaatctctaattttctaaacgttagcatcatttcatttacttcttgtaataactctctaagttcaagattcccgttagttgttgtaatcaaagcattagtatcaagccctcttattttattaatatcattagccgcttttctaatacttttttttaaattaaaaatataacaggtagcaataagcagtaaaatgatcaaaattatcactattactaacattcagctacctcctgattatttaatattgtatcgtttaaaatacgttactcctatcatacttgaagcgatgatcaatccaattcctgttaaaattcctgttaacaatgtctttatttctatctgtccaataactgccatgtcccgaagaattgtttcaaactcaaattgcatgattatactaccatcaatattaaaaacagtaataattgtcattaatagcatctgtgataccataactaacacgattgcgattgcattatatcgtgatgttttttgtgttattgcggcaatcatcactagtacgctcattataccacaaaagatcggcaactgtcgcagcataattattgttatatctaaaaagctagaataatgactcggtgcattaaagataatattaccaaaataacctaaataagtactgattgctattattgctatccctaatccccatgtcaaaaggagcttagcgaaatagtatgtcgtccgtgaaacatctgtagagataacatttttagcagtatgattagctaaatcaacacaaataactgcaaagactacaaaaatcagtacatagtacagattcccattaactttcatcatcccttcatctaatagctcattactctcaccagctacctttcttacatcttctggagttgctaaatcatcttctttagttacttctgaattactcgttaacccgccacttattccaatatgacctggcgatcttaaataaattgaaacactgcacagtgcgatgattgctagaagaaaaacataaattccttttcctttaaaaatcctaaataaatcagctttaatgatattcaacattctattcaccatccctaataatatttttaaaatactcttctaacgatactccaatttcactaattgcataaagttcaattcccttttcaactattgccttactaacaatgtgttgtgcatctaaataatcatatagacgaatttcttgatcatttaagactttgtaattagctgtctttagttcttcttctaataagacactagctttttttatatcatttaccttgagtaataaacaacgactacactcattatctaactgttcttttgataattctttaacgatcttaccaccttcaagaattccaaacttatttgctactaaatacagttctgataaaatatgactagaaatcaaaatcgttatattttcttgttgtaattgcaataacgtttctctaatctcactaattcctaatggatctaaaccattgattggttcatctaaaattataaaatcaggattatttaaaattaccaaagcaattcctaaacgctgcttcattcctaatgaaaactgtttaaatttctttttaccagtattatttaatttaaccttttctagtacttcctcaatcttgtgacgatcaataattccttttaaaatacagtaatactttaaattatcatatgctgataaattaggataaaacgctggactttcaatcatacatcccatcctatttttactatccctcctacccttttactgtataaaaaaagagttaaataactcttaatcaattcttaaataagtcttaattccgttatccttttattttataaccaattccccagactgtttctatatactcttgatttggattagcttgttttaacttactacgaatcttactaatatgaacatttagcgtattatcatcacctgaatcttcgtggtcccaaaccatttcaaataaaatatcttttgtaaaaacacgagttggactttctaataatatttttaatagtttaaactcaattttagataaatttatttttatctcattacaagtcactttataactattttcatcaagaataatatctttataagtaattagagctgctagagctgatgaaaaagctacttgccgatgctttaattgtatctttactcttgctaaaagttcattattatcaaatggtttgatcaaatagtcatcagctcccaaagcaaataggtcaagttttgtatccattttatcgattgcagttaaaataatcaccggtaaatctttcttctttttgatttccttaattacttcctgaccactaagacccggtaacatcaaatccaaaagtactaaatctacatgttcatctaataaaagtaatgcctctgtcccagaataagcactaacactttcgatacaatttaatcttaatagatcatggatcatattattaatatcattgtcatcttctacgatcaatatttttaccattgttatactacattccttcacttacacagtgatagtataacacaatatacctctccaagacatattggttttaagagcttatctttgtatttctaataagaaaaagaagtatctaagtttagatacttctggattatgaattatgagcaaattgtgaattatacaatttttcatactcaccttgttttgctaataattcttcgtgtgttccttgttcgacgatatcaccattattgattactaaaatcaagtcagcactcttaatagttgatagacgatgggcaataacaaaacttgtccgccctttcataacccgctgcattgcttcttgcagcattttttctaaacgggtatcaaccgatgaagtcgcctcatcaagaatcaagatttgaggatcttttaagattgctcgggcaatcgttaataattgtttctccccttgcgagatgttattggcttcttcatttatatgtgaattatatccatctggcagagttctaataaaatgatgaacattggccattttagcagcattaataatctcatctttgcgagcatccaaacgaccataacgaatgttatcataaattgttccagaatatagccatgtatcctgtaaaaccattccaaacatagaacgtaactcttcccgtggtaaatcacgaatatcaacgccgtctattttaatactaccacctttaacatcgtaaaaacgtaatagtaaattaataattgttgtttttcctgctccagtcggtccaacaattgcaaccatctgaccacttttaacattaacattcaaatctttcattaagttttcttcataataaccaaacttaacatgttcaaaatcaacatttccagccacttcgctcaaatgtttaggcggattagcttccggtacttcttccggttcttccaataactcaatcacccttcctagtgctgcaaaagcagactgaatttgtgatgataagttagatatttgcgataaaggatcattaatttgccaaatataacgaataaaagcttgtaactgcccaactaaaaatgttcctgcaattacatcagcagttcccactacagcaactgccccaattgctaaataagtaactaatgcatttaaaggtgcaatcgttgatgaaacgaattgtgctttaaaggcattttcttttaaattttcattaatttttttaaatttttcaactgattccacttgttgattatataataaaatttcattatatcctgtatacatttcagttacagtactatttaattcaccaagcgcatcttgttgatttttaaataatttttgactttttcctacaactagcttagttactaatagcgataatggaataatcatcgttccaataattgccatcttaggattaatcatatacatcattgttaacgctaaagtaacagttaatactccactgacgatctgcgtaaaactttgttgtagagcgttagaaatagcatcaacatcattagtaattcgacttaaaacatctccaaaatgatgattatcaaaatatcttactggtaatttacgaatcttattttgtaaagcattacgaagatcttccattgcttgctgaattgcattcgtcaaataaactactgaaatcatttgagcaactgttttaataatataaatgactactaaactaagtacaattttaataattgccccaaagctaatatccacacttgttaaactactgcttttagcaacatcgctcgctaattgagtagtgatcattccttcaaatgttggtgctaaaaccattgaaatattgaaagcaaaaatcattaggatagcaataataaattgccatttatacggcttaataaatggtattaaaccctttaaactttttttaaaactatattttttatgcatttgctaattcctcctcacttaattgagaagttgcaatctcatgataaatttgacattcctttaataattgatgatgtgttccttttcctacgaccttaccttcatttaaaacaatgatctgatctgcctccataatactagaaattctttgagctacaactagcatgattgattcggtcatttctttttttaactctttccttaaaattgcatctgttttaaaatccaatgctgaaaaagaatcatcaaagatataaatttgagctttacgaactaatgcccgagcaatacttaatcgttgtttttgaccacccgaaacatttgtcgctccttcactgatttcttcatcaaagccattttctttttccattataaatggataagcctgcgcaactttagcagcatattctacttcttcatcactagcatcctttttcccaaaacgaatattatcagcaattgtcccactaaataatactgctttttgaggaatcacacctaatttatctcgtaattctaatacatcataatcacgaatatctttcccattgattttaatacttccactactaacatcataaaatcttggtactaaattcactaatgtacttttaccagaaccagtacttccaataaaagcaatcatttcgcctttgttcgctttaaaagaaacatcctgaagaaccggctcctcaccatcaggataaacaaaagttacatgatcaaactcaatacttactttttcatcaaaatcgctatctgcaggtttatttttaattattggatctaaattgaagacttcttcaattcgtttcgctgacacctcagcccgaggatacatcataaacaccgtacagaaaagcataatcgaaaacatcgcatggaataaataatccatgaaagcaacaagctgtccaatttctaaagaaccagtagaaattagatgagctgctacccaatatattgacaaaccagcaacattcatcagcataaagaaaattggctgtgtcatggtcataattttaaataatttttttgaatatttagtaaagcgatgatttgtttctttaaaccgtttttgttcatattgatcattattaaaagctctaattactcgaatcccgctaagattttctctcgaaatacgattcaagtcatctaatgaactttgttgattttctgaaattggtttagtaatcttcgctactacgacaaccccaaggataatcaacggaattgtagcagcaataatatatgataacggtaacgaagcccgcgctgtcataataaaactaaaaataaacataattggtgtcatcaaagctgtccgaagcaatacgttaacaaattgttgaatttgaaaagcgtcattattcgtccttgtaatcattgatgatgtcccaatctgattaaattcattagctgtaaattgttgtactttagcaaagatatcatttctaatatcacgagtaattgcagttgatatttttgaacaacaatatcctagggcaatggttccacccacaccgataagtgaaactaaggcaatacagccacccatcatatagatgaagctaacgtctttattagtaaccccaacatctatcattgttgctacaatggtcggaattcctaattcaactaaaataaatccaaaaactgaaattacattaaaaaagaatagtaatttgtagttttttaaatactttaagattaatttcatatttttctcctttcattgtattgtgaagcaacatatcatatgataaactataaggtaaccttatagtcaaggagttatttaaatgaaagaaaaattattaacatgtggaacttttgctaaaatatgcggtgttgaaaaacatgttctttttcattatgacgagattaatttatttaaaccagcatatgtgaatgataaaggttaccgctattactcgtatcgtcaatatgatacatttaaagtaattattgctttaaaaaaactcggaatgtcgttaaaagatattcaaatatatcttgatcagcgcaatccccaattatttttagagttattgaatcaacaagaagctaaattgcttgagtatattaatgaaatgcagcagattcacgaaatgatcaaaaattttcaaacatttacaactgatgctttaaatgctaattatgatgaaatcaaagtaacttatttaaaagaaactaaattattattatctgctaatctcgaaaacactacctctaaaggcttcgctgactttatgaatgattacacatcttttattgaaaataatcatattattactggcgaattcgttggggtaatgatgaatgtcgaaaatattcgtaaaaatcaattatctaactactcttatttatttacaacaactaataatctgagtgaacaaatatttgttaaaaagggtggtaattatttatgtggctatcatcatggaagttatgatggtctccgtgactcatatcaaagaatcctcgattatgcagagcttcataaaattaaattaggtaaatatgcttttgaagaatatattatttttgatatttgtgaagcttccaaagatgaatacttaactcgtattacaattgaaatagcagaataaaaaagtaggtataagactcccaagttaaataaccaatgggcaggaagatcttaaattacctacttttacttataatttttaaaatttactaattctatcttatttttatttaaccattcacttaaccaatcggaacaaagaaaatcacattccataggtctaataagagtaaaagacgaatgttccaaaatatactgatctaaaaaaccaggatggaaaatagctactgcacaaggattatttttaataatatctaaatgctcttccatatatgtacgaggatcatacaatccatgttcatctaggctcataaatcctaatccagtaattccaaattctttttcccactctttatccaagctaggattttcaaagaataaattatttctttgagcaacattttttaaagcaataaagaaattattagaaaatactgcatgaccttcaaaataatctgggtctctacctgtgattgctcgaaacttcgctaattgagcttccagctcaatttcacattcagcaacattgatcgtatctacttgacgagcccgaatctctttactggaacaaaaattaccatttttctggactaacgacggaatcaatttaggatcactcaacggttttccaacacaaatattactgtgctgtcctaatgcgatatctaaatctttaaccaactcatacccatgcttagcacttgccatattaggcatcattccaacactagtgattacaccatctactacacttttataaataccataatttacgccctcgctaaacccgaggtcatcagctctcattattaatttcatatttctcaatactctcctttactttttttctttttttatctatttcctgattataaactcgtttgatataatccaatacttttcgtccgtcaaacgaagcatataaactaataggcggaactgttataattgtcagattctcttttaaacgtcgctcaagatttacttcttcataacgaatttgaggctccaataaaataatgtcataatttttatcctcaaactgctctgtagttagcgattcaatctgccaatccttttcatcaccaattacttttttcttcatatctagaacaatcaaatcagacattgctccagcaacactatgtaataataaaactttaaacggatgttttttagtaaactcatttaataacataattgctttatctaacacaattttacctgccatcttagtataatcataactatcaatcagcattaatggaatattaactttttgacagagcggcacaaattcattttgtaaatatgcaatatgtggagccaataaaataatatcataatctaccagcaaaacttggccactgacaacatcactacatttaatttgatattcgttataaatgtctgctgcttccattttttttaccaaaagactagtcgacatcccaccaccacaaaccaaaagaatttttttcatagcctctctaacctttcaatgatttctttaaaatactgataattaggattattgattaaattccactgaattgtactatcgctaataatattggaaattattttataaaagtcatctaattctttaattgctttattttcaattgcagataataaaattattctaattttatgtttcttccataataatggtttctttaaaatcgtaacagctacaaaagtagcattagaaaccggtttattagaatgcggaaaagcaattaaatcattgaattcagttgttgccaacgcctctctttgaagcacatactgttcaaaatctgcaggtagatcataactttttttgcactcattaattatttcatgaattgcctcttctttggaactaaatgattcatatgtaaaaaagagctgttctggaaaataatctagtatattagcctgatttaactgctttaaattatttgttattttaattgtatccctttgattaataagattattaattaaaaagattggaatatttactttaattgctaaaggaactgtcgtaaagatacaatcaaacttagttaaactaatgttttccagctcatgcaatgagcatacttcaagatgttcaatataatcattgaaattttctttaaagaaatattctaatagacgcgcgctccccaccccgctagaacaaatgaccaaaatattattacgatgaaaattatactttttttgttctagagacaaattaatatgtaaagcaaaataagctatttcatcttctgataaagtacagttaaaacgttgattgattacaacacaagctttaaccgctaattcataagccataatcagcttacttttaatctcatcctttaatggattatgcataaaggtaccgtactgaatccgttttactaatggaatcaaatgcaaagataatgctaattggagatttaaatctgcttgaaatggaatattagcaactttttcaattatcattaacatttcttttacaatatctaagatttcttgatttatataattattagaaagttgtttactgtttttaccacaaagatgcatagttagataggcaacctcttcaattcgatactccattgccattattttattcatcaactccataattgcacaacctaatgaatattctttctcttctttaatttcctcaagccattcagaatcaatattagcatattcttttttcatgacccgataataagcaatatataaatgcgcaactaggttatctaatacatcatcactaattacataatcagcatttgcaatagatgaaattacaatatctctaattcgctgaagaatatcaaagtccatttgatactcttcgaaatgagcaattgcacgtcgtttattaatttcatcaccttctaagtacataccataatatgctttagttgcaattgtaagatcaaaatcatgtaaatattctcttaattcttttaaactttgttttaattgtgttcgagataaataaagttcatcacatagatcatcgattttaagataattattacaatcaataaatcgattaaacaaataagctaatcgtgattcctctttaccattttgatctctttgtagatatgctaaaaaagtttctggtgtttcaattgttaaacgataaccaaaacttcctgattctattttagcaccgcagatatcttcattaatattcttaataatagtgcgaaccgaacgagtactcattttaattacgcttgataaatttgaaccactgacagtttcatgattcattagttccaaaattatcatcttttgattcttatccatcatccgcacctccgtttatattttatcataaagtatgataaagaggctggaaatccagcctaattttattccttgatctgtgcttcttctttaagagcgatgttatcttgtgttttaaaaaatggataatataaaattgcagatacaataattaaaacaatttctaaaataattcctgatactccgcaaattaaccagccatctaataataccggtgttcctgtcgctcccattgcaattcttggtaatgaaaccagaccactcttcattgcaaaataagtaattaaaatattaatttgtggtactaagaaatatggtaaagccataattggatttaaaatcagcggtaatccaaaaactattggttcattgatactacaacaagatggtaaaattgctaaccgtcctaacgttttatagcgattacttttagcaagtaacatatcaatagataatccaagcgtattaccaataccacctaacattaagaaatataacaacccaacagtaataatattttgcattggtgcccctgatgcaaaggctgcttgattttcaactccagcctgcataaatagcatcattgagaatggtatcgttacttgaccaccatgaataccaaagaaccaaaaaacagacgctaacaaagttaagaccatataagtaattaagctacctgataatgctgataatggagtcgcaataataccatagaaccattcactaaacgttacccctgttaatgaagcaaaagttccgttaatgattagaaatactgtcgttataacaaagccaggaattaatgcattaaacgatttggcaactgttggtggtacgccctcgggcattttgatgatccagccacgtttaacaacaaacgtataaatatagccaactaagattcctacgatcaaggccgtaaataatccctttgaacctaaatagtcaaaagcaatataacttgtagttgtttcttcaacgacaatatttgctagtggtgtcataataaagaaagctaaaattgacaacaaaccggcaggtatggcatctgtattcatgccttcatttcttataaaggcatacgcagcagtaaaagatacatatactgctaacatatcagttgtaaatttacccactaaacttaaaactgttccgacccccgagtcagctaaaaattgttgatatgcatctagtgataaagtactcagcagagtaaatattgctcctaaaataattagtggcattattaaattaaaagctgttgatattgcttttaaaattttattactccctatctttgttgctaatggtgctaaaacattctccatcttgtccattaatttttgcattaaaactatcccctttcatatttacaatatcattatataataccctaataaaactagaagtctgttaatttcctgttattgtaggaaaattatattttcttataaatatcgataaattctttaatcagtgatttatataactgaactgaaattaacatatcttcggcatgcactaataataaatctaaatcacttgaaactgttaaacatccagcatgaatcttacttgcttcaagtaatgtttcgttacccttaattaagtattcattagccttgacaaagttttgatctttgacatatgctaagaccttttgataagctagactgctttgctgggttaattgtatgattgatattgtttcctgctcggtattatttatcatattatcaactcctgcttttatcatacaaaaccttcatttgtatctaaagacaggatatttccacttaggcggaaatattgacaaagaacttttagtaattattttaatgataccaagaaacaagcagtttacctttcatttattaagaaaaaatgataatcttataagtacggaggtaacatacatgaaacaaataaaaaatataaatattgaaactttagaaaataatttaatttatccaatctatgaagatcaactaattgatccacaattaaataaagttctagattacaatcttgataaacttgttaataagaagtttaaagaactaactgtaattcatactttaggaaaatataaatttgaaacaattacatttattggtttaggttcttcaaaaaaaataacaagcaaacaaataagagatattgctgctttaattaaattagatgaacatgctactatttatcttgaagggataaacactgatcatcttgatattcatacaattacaagagcttttatcgaaagttatttacaaaattcatatcaagaacataaaattggtcatgagccaaaagtaattcatgaatttgatataatatttagccaggctgaacttgaaaatgatatccaattagggaaagtttatggtgagggaattaattatgcgcggatgcttagcgatacaccatcaaatttaatgacacctgataccctggttgatgaagcgataaagcttagtcaaaaatatccacaactagaatgcacaatcttaaataaaagtaatttagaaaaaatggaagctggaggaattttatcagttaatcaaggcagcaatattcctgcttatatgatttgtttaaaatataataatagtgacgatccttatactgctgtaattggtaaaggcttaacatttgattccggtggttataatcttaaaagtgacagttatggtatgaaatatgatatgtgtggtggtgctgatgttttaggagtaatgcaaatcttagcagctagtcaggccaaagcaaatgtctatggaatcattccaacaacagaaaatcttgttagtgacaaagcttacaaacctcaagatgttattacaaccctctctaaaaaaacagtcgaaatcgttagcactgatgcagagggacgattaattttatgtgatgctattacatatgtccaacaacttggagtgaagaaaatcattgatcttgcaacccttaccggcgcttgtgtttcagcacttggtgatgtatataccggtgttttcagtaattgtgatgaatactatgatgaatttgtccaagcgttacagattagtgatgaaaaaggttggcgccttccgcttgatcctgaatattttgaaaaattaaaatcaactagtgctgatttcaaaaactcagctggtaaacctggaggcggagctagtgttgcagcgaactttttagaagcttttatcgaagaaggaacacaatggttacatcttgatatcgccggtagtgctgacaatgatggaaccggagctactggtgcgatgattcgtagtgttgtaaatatgattaacttaaaaacaatcgtcaaaaagtgagcgtatcaaataatactctcactttttttcttaaaaacattaatgccataaaaaaatacattcgtgccatactcattttctatcttatgattattcatataatgatagatgtaaggaggaattaaaaatgaaagacaaaattttaattggtgaaaaaatgacgaaaaaaggagtgttccttaactatttaggtttagtattttttggaattattgcggtagttggctataatggattaatttctaaatatcttcatctaaataatcagcttaatattctaatcatgatatttatctttattgcggttttgctattcttaaccccaatcatcggctctagtgaaataattgaattcaatcataatgaagtccgctacttccacactaagggatatttccaacaatttgctgaagttattagaattcttacaggtaaacaagcagtccctgatattactttaaaaacaaaggacattgaacaagttaatttatcatatgtaccatttttaatgatgtatgctcaacaaggttatcaaattaaaataactttcctaatgaaagatggaactactctagcatttttaccaagtactattgatcaaatggaaaaaggagattatgaatctgcatttaagattttagaaacaaatggtgtagaaattgttgataaattaatgcttagaaaagcattgaagatgaataagaatgatttttatcaatatgttaatacgattgaaaaaggacgtaataaaaaatgaaagttattttagaatgttctcatcaatatatcaacacaataaagcgaaaacttaatgcacatttagagcaaataacttatttagattcatttacgggtaatgatctatcattatttattaaagaagtaaaaaaacttgaagacattgaaaacattaaaaatattaaaagtatttcaaacgctaatattgtttgtctaattgacagtggtttatttatgtttgagcttttagaatttaacccacttgcctttattcgaagtgccaatattaatgccgatcttgatgaattaatcaaccggattgagtacctcaataaaggcctaggggtaatgcttgaatttcaatgtggttatcaaacagttagaatgaatgtaaaaaatattacttatgttgaatcatatgctcattatcttttaattcacacattaaattcaacggttaaggttagagaaaaaatatcagtggctttacaaaaacttgaacccttgggttttatccaagtacatcgatcatatgtcattaatcatgaccggattaaaaaaatagatactgataatattacgttatctgatgaaactatcattcctattggaaaaaaatataagcaggctctaaagaatcattaattttcctatattgtaagttatctctttaagaataaaacatccccttattaggaggatgttttattcttaattaatgtcattttcttaaaaactactaattatcatattacgatttatcaaaaattgtttccatatgaactttctgtggtttaagtccacatgattcataaaatttcatcgctgatgcattacagctccaaacattgagtgttaaattataacatccgctcttttgggcaaaatctttggaatattcataaagctgcttacctatatgttgccctcttgaattttcatcaacacatagatcatcaatatataatgtttttacatctgttaaaatattgctatctaaatattgttcaaaaatacaaaatacatagcctaaaacaacttcattattatcaactgcaacgaagattggtctattatcatctttgattatttgcataagctgatcatcactatattttcttgccccttttttaaataaatccggtcttcccttatgatgcacaagacaaacttgtttcaacaaattattgatctgagtaatatctctattttctgctctacgaattaacatgactgcctccttaaataaccctcaattcttaatattatccttcataatacctatagacttattttcatttatcaaatattaattatactacttttttactaaattataatactttcaaattaatttcttcaaaaatcctcttattatctcccttaatcagtttctataaatatttaaaaaaattataaccatgctctttttacataaagtaaaaagtctagattttaatatctagactaactatcctctttgatgacgaggaatgaatgttcttatttcttcttcattgtatccaacttgaaaacgatgctcatccattagaattggtctttttaaaattgaaggattggctttaatgaaggcgattaattcatccattttcatattatcaaaatcaattttatttgatttaattattttactatttttagaaagaatatcatctgttccgttttcacagcgctctaaaatttcacgtaattcattagcatgcaaatcagacgaaaaaatatttttttcaataaaactcaaattatgctcttttaaccaggcaataacttttcgacatgactgacttcctggagctgtatatactcgaatcataataatcctccatctataaaataaggactattactagcccttcataaacattgtcctacaaattctttttcccatatttgttttaaagattttttgataagcactgttaatcgccatttcttcactttcgctttcaaaaagattaactaaaaaatctgcttcaaccaaaatttgataatctaaaccatctatttcactataagtatgatgatgaccaacaagataagcaactcgttctattaaagcttcatcataatttaaacgatttagcagcttaatcgcttctgccggtcctaactcttcttgatacttaccattagaactattatatttttcccaagcaggtttaattccaatatcatgaacaattgcggcaacttccaatctttcttgttcttgtgtagataacccctcatcaattccgattactctagcaaagctgtggactttaatcaaatgctgaatttgtttagggtgcccttgataaaaatcaatcatcgctaatattaaatcatttatcttcattatttttttacccttaatgtaataatatattcatcgtcagcttcttcagtttcactaataacttcaattcccgatttttgaatcaattctgtagcttgattgattgtattgattgcgattttaaaattacgagatactttagttggaccttttttatttttaggttttgttttaactggtttactaatcaaagactctgtttgttttacatttaatgatttttttaagacttcttgcaataccgtttgctgtttatcagcttccaagccaatcattgcacgggcatggcgctctgtaatctgttttgattttaaagcatgtttaacatcatctgataactttaataaccgtaatttattagcaatcgtcgactgttttttccctactttattagctaattcggtttgattcatatcatatgtatcaatcaatgttttatatgcattagcttcctcgatcggtgataagttttcacgctgaatattttcaatgattgctaatgtatcaacttgtttatcatcaatatctttaataacgcaaggcactgtttttaatcctgctaacttacttgctcgataacgacgttctcctgcaacaatttgatatccacgattatatttacgtacaataatcggctggatcaaaccattctctttgattgaagctgctaattcctcaatcttttcatcatcaaaaacagttcttggttgattttcattcgctgaaattttttcaatatcaatttgtttatatactttctctaacataacttctcctataggggttgtttttttatttttccaaacattcgtggatatttggctggagtatcccttaccttttttataatgatattacttcgatgattatcatttgttaaagtaaaatcaattgatttttccacttgaccacctaacaaaacaatgcccttaccagcttcctctaattcttccgtagcctttaaccctttaagggctaaaaagtatcctcctactttcactaaaggtaagcacagctcatcaagaatatttaaacgggctactgcgcgcgccataacaatatcacatttttggcgatgatctttagcataatcttctgctcttgcgctaatagcttgacaattacttaaatttaactctttaaataaatgatttaagaatgtgattctttttgttagtgaatcaactatagtaatttttaactcaggatatacaatttttaatggtacactaggaaatcctgccccagcacccacatcaacaatactttgatcagtaaaatcaaaatcaaaagcaatcgttaatgaatcataaaaatgttttaaataaaccccttcttcatcagtaattgctgttaaattcattttttcattccattcaaccaatatcttaaaatattgtttaaattgattgacttgttggggggttaaagtaattcctttagtttctaattgtttaatgaattctaattcattcatgtctattcctcattatatttctgttttaaatagattaataaaacggatatatccgcaggattgattccggaaatacgtgatgcctgtccaatcgttagtggccgaatttttgataacttttgctttgcttctaatgctaaattgctaatatcttcataatcaatatctgccggaattttcttttcttccattttgacttgcttgtcagcctgacgtcgagccttatcaatatatcccttatatttaattaaaatagtcacccgtttacgttgttcttcacttagttttggagcttcaacatatggtaagattttttcatatgttaattctggccttttgattaattctttagcactaatgccttccgttaaacgtgctgaaccaaaatgctccaaagcatcattgatctcatgtttaggagtaaaacgaatcgtatccaaacgatcaatttctgcaaaaatttctgacattttatcaagataagcctggtatatttgatcacttactaatcccacatcatgtccatacttcattagtctttcatctgcattatcatgacgaatcaataaacggtactcagctctacttgtcaacattcggtatggctcatcagttcctttagtcactaaatcatcaatcattaccccaatataagcctcatcgcgttttaaaatcaatggctcttttccttgattttttaaagttgcattaattcctgcaatcaaaccttgacctgccgcttcttcatatccacttgttccattaatttgaccagcagtaaatagatttttaattatttttgtttccaatgatggccataattgtagtggatctatagcatcatactcaattgcataagcatactttaaaatcttacaattttctaatcctgggatagtccgaatcatttcttcttgaacatcatgtggtaatgaagttgaaaaaccttgcacataaatcgtatccatctctgctgattcaggttccaagaagatttgatgttgtggtttatccgaaaatttaacaatcttatcttcaatcgatgggcaatagcgtggtccaattcctttcacaataccactgtacatacttgaacgatgtagattatcacgaataatctgatgagttttttcattagtgtaagtcagataacatggtgtttgttcttcaataggaataaactcattagtttgataactaaatgccaaattagcatcagttcctggctgtaaacttgtctttgagtaatcaacactattaatctctactcgaggtggtgttcccgtcttaagccgttgaatccgcatccctaaattagctaatttttctgataaatattttgattctttctgctgatcaggaccacttgcatgcttttgatcaccacataaaatctctgcttttagatatgtaccagttgttaagataaccatccttccttcaatagtttggccattatccaaaataactccttttacacaattatcttcaacaatcaaatcctctaccattccctcaatgatatcaagattctcctgtttttttaatacttcttgcatatatcgaggatatacttttttatcagcctgagcccgtaaggattgaacccctggacctttagcggtgtttaacattttcatttgtaagtaggttttatcagcagttttaggcatttgtcctcctaatgcatctatttcccggacaataattcctttagctggtcccccgattgatgtattacaaggaaggcttccaacattatcaaagttagaagtaactaaaactgttttctgattcattctcgctggtgccaacgctgcctcaattcctgcgtgcccaccaccgactactataatatcgtacattatatttccctccttaatcctaatctattgtactacaaatttcctatttttaaaacaataatcattagattgtcaattcatacaaaccaaggataattaaaataattcctgagattatatcagcgtattttcccttaaaatttaatcgcttaaatttttgaccagttccaataaaaacataactacaaacaaaggttgttaaagaagtaatcaactccggcattccagtaatacttgcaccaattcctaaagctacattattaatggttaaaaccaatgataagactaaagtttcttttaaagaaatattttttactgctgataaatgattagtaacaatgatctcatcacactctttcaatgacttaacaacagtatagattcctattaatagtaacagactgcttcctaaaaagtctgccaatgataaagaaatataattagttaaaaaatgtccaaagcgcattgcaccataagtaccgatcattgtaataaatgcaatcataaaatttttttgatgattaatatgtgtttttttgatcccataagctattccgatgcttagagcatcgatattcgcggatacagcatagagaactgctgaaaatatatgcataaactcaccccatctaatttatgcataataaccatttagctctgggcatcaggaaataaatttagtaattatggtatactataataaggagtcgaataattatgaaaaataaaaaaactaattttatttataaaagctgtattttaatctatcttatttctctagtttacgctttttatcttaactggggaggaaaatattttagtatgacaatcgttgcttgtcttaccccattcattatgcctttattaatgaaattgttaaaaatagaagttcctcaagaattttatattatcaatatcatttttgtctattttgcaagtttgtgggggagttgtttagggggttatcatcttccatattttgataagttcacccattttttcagtggaattattttttgtgagatagcttatatcttttataaacactttttacctaatgaaaaaagaaaatttttgatgtttattttcattaatgcccttaatgcgatgattgccttattttgggaattttatgaatatgctctattgatcttttttaactatgatgcaattaatcattactcaacaggcattcacgatagtattaccgatatgctggtagctgtaattggtagtttcattttaagcttatatcttactcattacgatcagcgtaatgataatcatttttttattaaattagctaaaaatattaaatttaacaaaacttctcatcctaactaatttcatctaaggaggaagctgtgtatcaacttaatggtgtttgcatgatttggcatacgacaaaaagcaatatattactacgacaccaaggtttgataaagatatcctatgatattcatagtagaaaagtgattaatgataataatgttaatttaatcaaatacacctgtttttatcgttaatctgattattctattctccaacaattattagagatattttgtattaaaaaaatagctgttagaaaataaattaaacaactatcaaagctagcagtaaataattgaaaatttcattgctgctagccaaataaattttgattataactcacacacagattctcttcatttgcatttaactggtacttgtcaaccttacactttacattgtagtaaagaaaaatatcggctaattaatctttgactcatttagcaacaataggctttttgattcatttcttattaatcattatttataatctaggagatcactaaacgttctatacaataaaaacaatgaccgagaactgcaatattataatactggtattttatcacctgctttaaaaaatggtaaaatcgaatctatacggataaagaagttttaatcatgaatcaaattaagtttcataagcgtcttggtcttatactcgatgaaatctacgatatttttaatccatctactcgtcaagaacaactgaatgctttattattaaaaaaactcactgactcaaagcttaaaattgattcttgttatacatcacttgataaaagtaactctctattaaattatgattataaggatattcctactttaaaacactattttaataattatctcgtttcatcagtttcttaaattatttttaatttagtcatctacaccagaatatttaaaacaatcagtcagcttatttaagaattaataaagcactcccagatttggtcattcaaatcccgaagtgcttttttctttaagcttcaatcaattcatcatcaacattatcatttatttcttcaacaatctcttgctttggggctctaggtttaataatactaattaccttaccaaagaaaacaaatgtcattgcgtaaaagaaataactaaatgtatttgacataaaataagcaacgatctcaccaaagtttgcgccccacgagatacttcctgcttcaacatatgagactacagattgataagatatatttacagtatacccaaaataacagattatcaataaagctattgcataacaaattagcgtaaacgctggtttataaaaccaattcttaattttttccatttttaaatccctttctatttttaagatattttaacgagaaaataccgaataaatatgtgatgaatacctaattgtatggttacactaaaaacttatttcactaattgaaaatattttaaattattttgtcgtaaatgctatgataaagccaataaaggagttgaattgtatgattgatattttaattaaggccggtggctttattttaattattatgttaggatttgcactaaagacaaaaggggtctgtacccgtgaacacggaagttttttatcaacaatcattatgaatataacgcttccatgctcattactttcatcaattaataaccttgagattacccccatcctattagtagcccttgcttgtggcttcttaggcaatgttattactaacctttctggttacttgattcaaaaaaaagaatcacccatgaccagagctctatcgatgatcaactcatctggctataatatcggaacttttactttaccatttgttcaaagtttctttccatctaacttgattggttatgtttgtctttttgataccggcaatgctttaatgtgtttaggaggtacttatagtgctgctagtacagttgtagctaatgaagaaaaacaaagctttaaaactgttgctaaaaaattattttcatcaattcctttttgcacttacatcattttgtttttcttatctttatttcatattgcaattcctacacaaattttaacagttactagtattgctggtaatgctaatgcttttttagcaatgttaatgattggaattttattggaaataaaattagatttatcacaaatcagactgattaaaaaaatacttttaaaccgctatgcagttactttggggttatccttatttgtatattttattttaccaattgatttaactgttaaaaaaatgattattttatgcttatgttcgccaatatcagctgttgccccagttttctcaaatcgtttaggaagtcgttccccagttccttcagcaatcaactctttaagtattattattagtatttttattatgacgattttaatcttatttatggtttaataaaccggtatttctttatgtattgattaaattaatgatttgtcgtatttatttaatacttgatacaaagggattctcacaatacttcttacagccacatcaacaaggcgaacccctttttcaatatcatttgctaatcgctcttttaaacttttctcatctactaaaagcaaaatacgctttacttcacaatcaataaaatctaatcattctaaacacatatcaataattttttgttcatgtatcacctaacaaaaaaactagtcattaatttgactagtttatttccagaagttttttccacttcctactgagataattttaaattgggtattctttgatgttccaccagtaaaatatttaccagcttcagtcccattaaagatatcaatcttgttacctttaattgcaccaccacgatctacaacaatcccatatgcagttgattcaatacttaaattatgattagtaatttcaataattgttccaaaaggaattgaaggatctgcagctaagcaataatatgaacgtccattatatgttaatttaggactgtttgatccttgtactccagaaatcggacttaatttaatgccggttgatgaagttccatttcctccagcacagtcgcctccataagtagtcagtcttccagtaaagaatgctccttcttggactgcacctgtttcaattattgtatcagtagcttgtgataccacctgactaccaattaattctcttcctacttcattaccattttcataagttacgcggtaagtgtttttcacttgcccgttttgcccttgttgcgcaactttcgtagtaaataactctaatccagttgtatttaccgtatttgattctactgtaatcatctcgtctatatccgcttgattaactcgagtgatttgtattaaatcacctttatttacaatataatttaaatctaaatttaaaatatcttgaggatttacactgatttttaaatcatcaagaacacttgatactgacgcttgtctaattaaatagtccttttggtcttgatttccatcttgaacttttacatcaattgtttccacgtagttatcaatttggtttgttgctccagcatttaatgttgtcgctacaattccaatataggcaatcattactacaagtaaccctttcattctggggtctgcattaataatagcctctttaatttttttcattaattttcctcctatttaataccaaaaagttttttggcattaaacgttgtcgcacttgcaacgttttctatctccatgttctttagcttagctatttcctgggcaatatacacaacatttgcaggctcatttaactttcccctaaatggatgaggtgttaaataaggacagtcagtttcaattaataaattctctaagttaatagttgctgccacatcttttggaactcttgcattcttaaatgtcaccggacccgctaaagaaatgtaataaccaagttttacaaatctttctgccatttcaacagagccactataacaatgcatcactccaggatgtccattccgttttagtacttcgtaagtgtcctcataggcgtcgcgacaatgaattacaactggcttttggtgcttcttagctaagtccatctgccattgaaatacttccatctgcttttccttaggaacactgtcccaataataatcgagaccaatttctccgagtgctactacgcaaggttcttctaagtacttgtcgatgatgttcatttgatcttttgttgtgtttaagcaatcgtttggtccgataccaactgcagcatatacgaactcatattgtttagctaattcgattgcaatttgagacgactttaagtcatagcctacgacaaccatattggtaacattgttatctagggctttttgaacaaacacatcgtgatcttcatataattcatcactattcaagtgacaatgagtatcaaagtacataaatctcacctccgctgtatattaacaaaatcaattacatttgtcaaatatctaaactccaaggcactagctgcaaagaaaaaactatgataaaatcgatatttttttattactatattcctttttccacatattttaacatacaaatttcgataaaacataaattttttaagaaaaataccatgtttttgtagagaaacgtaataaaataatcaagttgattttacatcctaatttttgacaaagtaatcatttttatactaatatcacaaaaaaacaagcagagggaaagctgcttgtttcaagtaatacagatagagggaaagctatctgtttttatttagatatcagggaaaggatatcatgaagagtaatttattgtagaaagaattgttatctttactacaattaacagtatagtaagtaaatatcgttagatttaatcaaaaatacctaaaattaactattaaatatggataaatatgttaatggataagagtataaaatacaattgttatgatttggttacgtttgattagtttcgttgactcctattattgcctatgctattattttggcatcgaataagtggtggagtctgtcataaagcaaaatgctttatttattcgatgtaagcttacgattaaaagaactattttgatagttaagtaaattacgatttagacagattcaagaaagaatctgtcttttttattttgacaggccttgaggagggataacgggtatcgttataaatatattttttggtttttaattttagggaatgagtattaggagaattgtcgtatgaatattaatgaagataatgaattgaataattatcaaataatgtatgtgaccccggttgaggcctataccttaatggaaagtagtatggacggtttatctgaagaacaggtatcacatcgtctcaaaaagtatggtaagaatgagatttccaaaaagaaacaaagttcaatgtttaaaaaactaatttctaattttactagtctaatggcattactattatggggtggaggattactagctatcctttctggaacagtcgaattaggaatatcgattttctgtgtcaatctaattaatggcttcttttctttcttccaagaatttaaagcagaaaaagcaactagtgcgttgcaaaagatgatgccatcttatgcccgagtagtacgtgatggtaaagaagtaaaaatatttgctgaggacattgttcctggtgatataatgattttagaagaaggtgaccgaatttgtggggatgctagaatcttacgttgtagtgatttccaagtagatcaatcaactttgacaggtgaaagtaatccaattagaaagaattatgaggcactgcaagaaaaagtttcatacttagaagctgaaaatatgatctttaccggtactactgttgcttctggtacttgccactgtgttgttgttgcaactggaatggatagtgaatttgggaaaattgctaatttaactcaaaatactgaaaaaagcttatctccattacaaaaagaacttaatgttctaactaaacaaattgcaattattgcattaagtgttggaatcgtgtttatgctgattgctgtatttgtaattaaggatcccttattggagtcatttattttttctttaggaatgattgttgcttttattcctgaaggtcttttacccgctgttacgttatcacttgctttatctgttcaacgaatggctaaagataacgctttagtaaagaaactatcggccgtagaaactttaggatgtacaaatgttatctgttctgataaaactggtactttaactcaaaatgaaatgacggttaatcatctttggactcttgatagtcaaatggatgtcagcggcgaaggatatgttccaaatggaaaaatctatgttgatgaacaagaaattaccgcaaagaaaagtaatgttttaagactattattaagtggtgcagtactttgttcaaacgctaagttagtaccaccacaaaataagagtgttaatccacgttatacagttttaggtgaccctactgaagcatgtttagaagttgtagctaaaaaagctgaaattgatcttgataaattgaatagtcaatatccacgaattttagaattaccttttgaatctcgacggaagcgaatgacaacgatccatcaattaaaagactcttttgaaggcaatcagagaattgcatttgtaaaagggtctccaaaagaagttatggaattatgtaatcgttgttttaaaggcagtaaagcctgtccaatcagtgaagaagaccgcatcaatattatgaaagcaaacgatatgtatgctcgtgaagggttgcgagttttagcagtagcctatcgtactattgctcataatgataaaaaacttcctagttcaattcgcgaatatacacctgaattaattgaacaagatctaacttttttaggcttgattgcaatgcaggaccctccacgaagtgaagtcaaagaagctgtggaattatgccatagtgccggaattaaaatcgttatgattaccggagattatggtttaacagcagaaagtattgctcgcaaaattgggattattaaaagcgataccgctcgaatagtttctggaacagaattaagcaaaatgaatgatcaagaacttaaaaacgttttagaaggcgaagtggtctttgctcgaatggcaccagatcaaaaatatcgtattgtttgtgctttacaagaaatgggaaatattgtagctgtaactggtgatggtgttaatgactctccggctctaaaaaaagcggatattggtgttgctatgggaataactggtaccgatgttgctaaagaggctgctgacatgattttaacagatgataattttgcctcaattgttcgtgcaatcgaagaaggtcgtgctgtttataataatattcgtaaattcttacgttatatttttgatagcaacaccccagaagctgctgcccctgctctatatttgcttagtggcggtttagtcccaatgccccttacaatcatgcaaattttaactattgatattggaactgatatgattcctgcgcttggtttaggggcagaacatcctgaagataatattatgaatcagccacctcgtcgaatcgatgaaagattacttaataaaaaagtaattttagtaggttttatttggtatggcttgattataacgctatttgccttaggaggatatttccttgtaaactatttgaatggttggcctcataatccattggctccagaaggaactgcgctctataacgaagcaacgacgatgatgctagttggggttgttttttcacagatgggaatggtcatgaacaaccgaactgaaaaagaatcagtatttaaacgcggaatcttctccaatcattatattaatttaggattagttgtagagtttgttattttattagccgtagtctatattccttttttaaatggtatcttcaatactgcgccaattgggttaatagaatggctatatgctttgccaattccttttattgtttttggaattgaggaattaagaaagaaaatattaagaaataaagacaaataggaggatggaaacctatgaaaattataatcgttgggtgtggaaaatttggtacccgattagcaaattatttaaataatcaaaatcatgatgtcactataattgacaatcgtgaagaggcttttaataatcttggtggtaattttaccggacggacagtattgggaatggggtacgataaagatgttctagaaagtgccggaatcaaagttgctgatgctttgatcagttgttcaagcagtgatgctattaatgctgttgttagtaatattgctcataatatttaccatgttaataatgtaatcgccagaatgtatgataaatcaaaggcacggatttttcgttcaatgggaattcatacaatttcaattactgatttgggtgttgaaaggatcttagattattttgacagtaatcggcttcaagtagttaaaaaaattggtgaagacagtgaaataaaaattattaaaattaaagcatccttatctttaataggaaaaacagtcgatgaaatttctcttcatggtgagtttgaagttgtcgcaattgaacgacatgatattacaatgatgcctttaaaagatactaaaataaaagataatgatacgatttatttttctgtactagaggaatcattattaaaatttaaagaaattttgtattaagaggtgaaaaaaatgaaaataattatagtaggtggaggtcaaattggttcttatatcacaagtttactacttaaaaataaccatgaggtccgtgttattgaaaatagaactaaagcacttgaaaactataaaaatgccggactaccagaagaatgtttagtaatcggcgatggaacagatattgaggttcttgaaaaagcaggcgttagaacttgtcaggccttagtctgtgtaactggattagatgaagtcaatttaactactgccatggtttctaaatttgaatatgacgttccacgaataattgctcgtgttaataaccctaaaaatgcctggttatttaattctggaatgggagttgatgctaaaatcaatcaagctgacattattggtcatatgattgctgataaaatgaattatcaatcaattatgaccttaatgaaattatctaaaggtgatttttcaatcgtgcgaattcgagttgattatcaatcacgatatgccggcaaacaaatttctgaaatttctttaccaaacaatgctctcttaattgcgatttacaatgatgatgaattaatgattcctcacggagatacgctaattgaagccggacaagatattctcgcttttggcgatgagcaggcaattggaaaattaaatgaaatatttgttagttaataattaacacaaaaacagccaattaacttttctatatagcaaactctatttactttaggaagtttctataaaagattgtttaatggctgtttttcattttgagtacagatagtgggactctatctaaatttattgatatccggaaagaatatcatgaagagtagtcatttggagaagggattgaaaaactatttaaacaatcctgactacattccttagtatagtaattaaatatcgctagattaaattataaatatctaagattaacttctaacaacggtaaattatgttagctattgataatttaatactattttttgatgattataatcaatcactgataaatcataatcatataaagactttaatgatgctgaagttattacttcctcaggaactccttgaaataagattttcccatctttcattgcaatgatttcatcactataattgattgcttgattaatatcatgatgaaccataataatcgtcatttgatattttttatttatttcttttattaaattaagtatttcaatttgatatttaacatctaaatatgtagttggctcatccagtaataaaataggtgttttttgagctaaagccattgccaaccaaacacgctgctgctgaccaccagacaaattcgctaacaaacgattttcgtattcttttagattagttgttgcaatggcccaatctataatttgataatcttcctcgcttagattttgatgataacttaaatatggtaaacgtccataaccaacaattgtcttaacatctaaatccccataaatctgattcttttggtgaactactgcaacgtttttagcaaattccttgatcttatagtcccagacatttttatcatttaatgttattgttccatctttggctttataaatacgacttaaaagcattaataaagtcgatttaccactaccattaggaccaatgattgatgtaatcttattctttttaaattttaccgaaagttcttcaataaacggtttatcttgataactaaatttaatttttttaacttccatcaacatcaatactccgtttcaataagataataaataaaggtccaccaatgatagccataataatggctgccgagatctcatagggagccataataattcttcctaccgtatccgcaactaacaaaacaattgctcctatcaatatactaattggtatcaaatgtttatgttcagttcccactaacaatcttgaaatatgaggtactagcagaccaataaagccaattaccccaactactgctacactaatactgcataataaaactgctaataatgataaaccaaagcgatatacattcacatttactcctagcgaagtaagggttcgatcttctaaccctaatagattacatgccttcgccataaataaagtaatgattattacaggaaccaaataaattaataaggtcataacatcttgccaagtatacaaggaaatcgtacccgtagcaccacttgtgattgaagcagttgcactatttgcgagggtaacaagagcactgatagtatagttgattgccaccccaatcaaaatgattcgagttgttttaaatccagctttccacgataaactataaataattgcaaatgttattaaacctccaaagaatgatagtaaaggagcaatcgcagatagttgaggcaaaaataaaccaactagtacactaactaaactcgccccattagcaattccaatgattcccggatcagctaacggattctttaaaacaacttgaaataaaagtccagataatgctaatgcaccacctactaacatggagatgataattcttggaaagcgaatactatatacacttgctacaacgacatcgtattcaataaataaccctttaaacaattgaacaattgaaacttgaatacttccaagatttattgcgataaaaaaacagataaataatactaatattaaaaagattataaatattcgcggatgttttttaattagttccatataaaattccttctaaattttctaagcctttttgataattaaaattagcactcatcccaaaataattattatctaaattataaacttttccattttgaactgcactgaatttactccaaatatcattttgagcaaattcggtttcaaaattcttcattacttcctctggcatcgcatgactagttctcaagataatatcaggattttgttgtaacatatcttcagcattgacattgacaaaatcctgaccattaccattaccataaacatttgttccaccagctaattttactaaatcaccaacatagctagattctgtagcaacaaggtagctgccacctggcaaacccatcaaaattaaaacccgtggacttgctgtgttttggtatttagctctaaattcaaccatataattaacaaattcatctactaatttatttgcttttttctctttacctaataaacttcctaactcctcaatacttttaaacatacctgctacacttttaagatttaagaaactagaacttacaccaattttttcatatttagaagctaaatcaccctccaatgaattagggcttaatactagcgatggttttaaagttgacaatacttccatatctggcgacattgcagttcctagttctgtcgcttttttatatttctttggtactgtataactttcagtcgtcggaatgccaattacctgatcagctggaacatccaaagcttctaaaatttccgtaacagctaccgaagttgctgcaatcgtcaaattattattatcactttttccactttgatctacacaaccaatcattgacaaagcaaggacaagaacaagaaaactattttttaacttttttaacataataatatgctccccctcctgctacgacagctataaccgctacaattccaataatcaacagcgtattattactactatcctttttttgctcactttgttttaataaatttttaactgtcaatttcttcttttcattaactttgccatttgtatcaattacatggctagataagccagaaataccatcaaataaactttcacgtgacacttcccccactgtagttaccggcgtttctaccactggttgttcttcatttgttgtcgtatcactagtttgattagaattcgtacttgtattattgctggtgctattattagtagttgaattattatttaccgaatttccattatcggcagtggctggtaccatggtactagtgtatacacctgttcccggagtaatagatccttgatttaatttaataaaaaattgcacatcacgccccattggagcgacatacatgataggactaatataatcatttaatgaattaatttgaattcgataatgatttaccgtgtcaccattagcactactacttcctgttttagtagcactaacactattaaaagaaccaccactattcatgattttaaatcttacatttgaaacatttgaagctaatcccaaaccaacagtaatataatatttaccaccagtttgctctaataacaaattgccttctacaatacttgaaaccatgctatcacctaatgtaatattagtaccaccatcttcggtgttaccagttagaggattaacgtaagacgtggagcgtccaattaagtacgctccatcgtctagggcaaaagctggtttaatattaattgtcatcgttatgatggcaaccaatattaataatactttttttatttgcataatctttttcttgttaaatatgccacagccactaatgatgaaactaataatcctcccattaattccatattagcattatctccagttttcactgaactacttgatgttcctgtagtttggttagtcgttggagttgttgtatttggtgtatcgtttgtattattatttgattcaccatctaccttaggtgcttcaattgaatcagatacaaattttaatgtgctataatcaactttcattcttgctggaatatcactattccccatcatagctacatgtggatttaccacaacatcaaataattcttcctcatttggtaaaacgaaagaccacatagttgctttaccatcagcatttttacttacaataacagctggatttgatttataatcatcagttgatgaaccaatgtataattcctctaaccatgctttaattgttcccatagtcatttctttagttgtgatatacattgttgctacaccatttttaactactactgtagcttgactgtcaattgcacccgctgccattgaagccttatcttgagtcgcattccataaagcaacatctactgtatatgtaccatctttagcaaatttgcttgtactttctggtactactagtgttggattatccaatcctaaagataatctcgcctcagaaccatgagtacttccaccatagtagaattttacatttgttaattttgtattttttgctaatgtaaattgcatttcacttacatttccatcactatcacgtcctgtgatatcagctaccttataaactccagcagcttgctcaacttccattttatcaacgtatgcagtttgaccatacacagtaactgcacccatttgtaatgttactaataaagttccatcttttgaagtaaccgtagcgctcttgaccgcttgggcagccattgattgtacatcttcatttgcttttaatacatcgctagtcacagtataagtaccatcagctaatgtatattcaggtgcttctggttcttcaggaataacaatatccgctgtactatattgaatatacgcatcaactgtcgtatccatcgcgtcaacaaacatttcaatataaacaccctcactgtttaccgctacaggtattttaactttttctacttgttgctttccttgatcatcttcgcgataactaataacttcagcagcatgtttttctgattttgtatcagtttcataatattggatatttcctgcattaccaactaagcccattaaatttaatgttttaaattcagcagttaaataccactttccttcctctactgataattctccattttctgctaatgctccagctgccattgaatcatttgcaatattacttgcattcttcaattttgttggaatagtatatttaccatctggtaaatcgcttacctgggcagcatctacattacttaatgtggctatctgaattccaaatgccagcattaaaactaatactacttttaaaagttttttcattttcttcctccctctttttctttgttagaaaagactaactatttagttaaaaaatatagagaatatattctctgctaatgttagctaaaactaactacatccattattttacatacatctaatcttaaaacaactactaattttgttgcccccattgaaacaatcttttcaaaaaatatcttttttctttataaatacagcattttttgatgtttcatcgatgaaatactattttataataacgttcataattgcaatactctcaggcatatgaattttaccaaccgttggtttaacctttatctttacactcgtttgcaatatccgttcttcctttgaataatgaaaacgtaattttgaaataggaataatataatcatccttgatcatacgacattcgagatagtcttctcctacttggtattttaaagaactcagcttccctttaagaaccattttccccatcatcgattctcgttcaacttcttttgactttaaaactaatcctccatgtcccatttttatatccaatattcctggatgaaagaaaccatcattagccattgatatttccatcttatcagctttataaacagtaaaagcaaacaagtattgaccatcatcaagattagcactaagcatatctccactaatttcttttacattatcaatcaattcaaataatctttctttactagtgttgttaacaagtttagcacgtgctttagatgatagtgttaaaactaatgatagtgcctcttgatacgcttcttcatcatcaaaattagctgtatattttaaccaatcagataatttattaatatcttttaaatattcccttgccattctacatccctggcatgataaaattcccttccctttttcagtcgttaacccctcctgatagaaggtattcaatactcggctaaacgttgattttgatactccgacctcttgcgctaaccgagtaactgtgtaatccatttctctttgtttatataaaaataataaatatgatagtttttcttttgttagctgcataatcccctccaaagttagtttatgctaacatattatcgtatttattcctttaaaacaagataaaatagctatattcatgatgaacatagctatttttaactacttattacttaaagatcatatgaaaaacacactgggcaattatgttctttatcaaaaataatttgcgtcttaacaccataaagttcctgaatcacttctgaagttattatatcttttgggcttccttctttaaaaactttgccttctttcatagcaatgatccaatcactataacgtgaagcatgattaatatcatgtaaaaccatgacaattgtctgttgttcttccttatttaatttactcaataattctaatacttctaattgatgaccaatatctaagtatgttgttggttcatctagtaaaattgtatttgtctgctgagcaagtaccatcgcaatccacactcgttgtttttgacccccagataaatcatgaaccaacatatcctttatctcaaaagtttgggtttctttcaaagcccactcaataatcttttgatcttctttagtcgatgatatcctcttatatggataacgaccataactaactaactcataaacacttattccttcaggggtatttagaatttgtgagagaaaacctattttctgagctatttcagctgttttcatagttttcaaatcttttccatcaagaattattttaccatcttttaatggtaatacccgagccattgtctttaacatggttgatttcccacatccgtttggtcctaaaataacggtaattttatttttaggaattacaatattttgatctttcaaaacaatctttttaccataaccggtgcttaactgtctagcttcaataattcccttcatcatgctctctccttttttaatagataaataaaatacggcactccaatcaatgataaaataatccctgttggaatttcaccagtactcatcagacttcttgataaactatcaccgataataaccataaggcttcccattaacatactgacccataatgaataacgatgattgctaccaactaaccttcttgcaatatgcggtgcgattaaacctacaaaaggaatagaacctccaaaagcaatggtaaaagctgctaaaaatccggctaaactaattaaaataattgtttgtttttttaaatcaacccccaaggttattacactttcctttcctaacgaaaaaatatttagaacatcttgatatttccacaatattactccaataatcactaatattgttattaataaagctatttttagccagtctgttcctgttagaataccagcattccataattgcacatacgaaaacttttgacgattcagctttgctgagaagaatagaattaacccttggaatcctaaattaagagctaccccacatatagtcatccgaattggatctattccacgttctttttcataaatcaaaaacattagtaaaccaatcgttattacagcaccaatcattccagctaaaggcatccaaacataatctaaaaatatatctgttccactaactaaaatatataacaaaacaaagaatgaaattcctgagtttattccaattacacccggatcagctaaatcattttgtaatactgtttgtaaaatatgtcctgccaaagccattccaccacctactaaaatggcacataacaaacgcggtaaccgaaattgaaagattactaattgtgtatatggatcaaataattcacttaattcaattttcatctgacctatcgtgaatgacaaaaagcttgatactaataaaatgattatcagaaaaatgattattctttttttctttaacattttttatttatgctcctttccataaaaaggaaaaatggaacaccaatcagtgccataattattcctagtggtgtttcataaggtggttgtagatttctagcaataagatcgataagaattaaaaagactgctccatatatcgcagacataggcaaaataatttgataatcctcctttttaactaatcgtcttaccaaataaggaacaatcaaaccaataaatccaattgacccaacaatactaactgccattcccgctaaaagcagtgccactaaacatactagtattttacaacgaggaacgtttacccctaaaccaacagcagtttcttcactcattgaaataatcgtaatatttttcccttgcctcaaaagcaaaaatagaccagaaacaaataataatgtcgctaaaataagttcttgatatccaatattagcagttccgcctacattccaatatgttaattcttgaccaattccaaaataaattgctataaactggcttaacgaagtaaagaaaagtgagactgcaacaccagctaataataatcgtttagaattattagtatacttcccttttcccattgtcatcgttaaaaataaacctaatcctgctccgacaaaagaatacatcatcattaaaagaaaattactgcgactgaccaaagcaaagcaaattgctaacataaaagaagcacccgcattgattcctaaaattcccgaatcagctaaatgatttttagtcagtccttgcattgctgctccagccatcgcaaatgcactaccgacgattccagtcgctaaaattcgaggaaatctaagattaataataacttcataatcatttccattactctttttacctaaaatgattttaaaaaaatcttcccatcctattgtcaccgcaccaaattttaatgaaaagaaaatgatgataggtaatagacatagtcctactatcagccattttcttacttgttggttattcatacagtgctaaaatactttgagtaatgttttttaactgttcttttgttgataaaatatcttgatagatatatgcacttgaatcatatgtaattaccttttggttttttacagctggagttgagttccatacactattatttccaactaaatccataggatcttcttgccagccaccaatcattatcatatcaccggcatactcattgattgcttctaatgaaatagaacgatattgttcaccattaataatttctttttgaacaacttcgggtgcttttaattctaataaatcgtataaaacttctccaccacgaccttgtttatttccatatacaaataattctttactatatgtttccatcaaagttatcgtcttgttagatattttagcatcctgtaactgctgcttatatccagcaacttcttgattgaaatcagcaagcaattttttcccctcctctttcttatttaaaacatcagccatccaagtgattctttcggcagttgacatatttaaataatcaactagtaccgttggtgcaatcttagataaattatcataatcagcctcagaatatgtaataattaaatccggttttaattttgtcactgcttccatactatactgcccatacgcatcatcaccattaattgaaggtacatctttcaaatcttcttcaaatacagaatctttgtatacatatgtagttccaaccggctccactcctagcgcaagtgcatctccaacaaaataatctattacaacacgtttaggctcattaggaatctctatttttccttttactgtttcaactgttcttattgtatctttagtggcagctgaacaaccagttaaaataaataaacttaacactaatatagttgatagtacttttttcatttatatctcccttcttagttagttttagctaacttatgttgtgattctagcatgccttaatttcttttacaatattttcactaatattatgtatttttacatttattttatgtataatttaactggtgataattatgatatgtagaaatttgacagagtactataatattttctttaataaactagctttccaatactatcagtatgataacttttccttatatataaatcctcaacaacctgaagaattcattattcatgtgcatattgcagatatgtatgaactttttgttggtgattttactgcaccctatgatattgaaatatcatttgaaataagtgaaacatatctacagctaggaatgcttctaactggtgaaattgagtatgatttaaaagagagtcataataatcatttagagccttctagtttttatttaaatggttcaaagcgtagtggattacaagtttggaaaaaaaatcaacattatcattctacagatataatcataaaaaaagattttttcgaaaaaaaattatcggcatatggatattcctatacaacactagaaaaaattgaaaaaaataaaatatttcgaccactcccctctaaacttttacaattaatgcaagaaatatctgacactttaagaaataaagcaatctcacaactatatcttgatgctcaattaatgaagatcgtctactttctgttacctcaaaataatattctatatccccaatctaaaactattacaattaaactaaaatgcggtcgaaacatcttactaaataatgatgatcaagaaataatccagcagattcacaatgatctaactgttaactatcagcatcccccaacaattaaggagctggcaaagattcactatattagtgagcaaaaacttacagctggtttcaaatacttatatcattgtagtattcatgactatattagtaatttacgcttaaatatggctaatagtatgctgttatctgaacaatctacaattattcaaattgctaagactttaggtttttctaatgctaattcttttatctatttttaccgtaaaaaaactggtataacacctaaacaattccaattaacacaacgctaaaggggctgttttttctcaatcaaatagaaattattatcaacctcccatattatcttatataccctttttccataaaaaagtactctaacaagagtactttttaattatatttttttctagttaataataaaattattaacattgtcccacccaataaactataaccaatgatttttgaatcatcaccagtattaatactattttttattgatgaattagttgtctcgatcacattactattattttgattatttacattatcttgatttggcttgtcagtagttgaattatcagctttttgacgataatcatatgtcattaacattccatcaaactttccacgatttagattcttgaaatctccatcatttgattcactatacaccagtaatgaaatttgataatcatttaataccataatctctgaagcataatcagcttttgaaccaccaatattttcgattgttttcaaagtaccattcttttcataatttgcaataaaaacatccatacttcccttattaagacctgttacatcatagtctgttcctcttgattgaccaataaatacatattgattttcaagttctatcgcacttatcatttcactagcttcactactcttgatcacattgacccattctgtctcaccagtttcattacattttaaaacatatgcattgtcataccctgttccaattggagcaaatgtgtcagtagttgatttagtgttacccattaaaatgaatccaccatcactagtagctaagacactattacaataatcattgcgatcgccaccataagctttagtccacaataattcaccagtagcactaatttttgcagcaaagcagtcaaatatatctccataccagtcaacatctgcaaaatcaccactttttgaagaaagactaccagcaacaataaaactgccatcacttagaatatctaatcccgaacttgaagtttcaatattttttccacctaaaactcgttgccagacttttttaccatgagcatcatatttaactatgactaagtcatataatcctcgattttgattttccatatcgccatcatttgaatttgtttctattaaaacagcaataccgccatcatccgtagctttaatttgtttaacttgatcgttggctgagccactaaaattactcatccagatcagcttactgttagagtcatatttagcaataaaagtatccatttgaccatgaacggtaccagcagtatctaactgtgcaaaatcaccggttggagccacatacaccccttcttgatatccaccactaactacaaaaccaccatcatctaggccacataccttagctgcatgtgcaattgagtcgtactctgttcctcctaaagtaagagtttttaaaagttctccttttggatcatattgattaatataagctattgaaccaccttttaacagattttgaaaatcaccatcatttgagtatgattgccctacagcaacaatatttccatttttcaaaactgtcatatcatcagtataatcataatcactaccaccaatatttactttccaactagttttaaagtctggctgttctacttcaactggagcaaaatatggcggattggtagtttctaccatatctttactagagaaagataaacgtatatctcccattgctttatcgatatgtaatttgaccggtgtatctaaatcatcaacttcaagcgtaactgtttttacttgtgttacttcatcgtactcatctttcaacaccgctatcatttcaccatttttttcataactaacttcccctaatgttgaagcgctaacttgagttcccataattgttgcgttagtaaaataaattgttacagtatacttaaagccaattttttcaacatatgcatctttatataataatggtgccatcattgaaagactatcttcattagctttccaagcttctaccggcactaaatacttttcttctgcatattgctctagtgttgttcccgctaaactagctaaaaagccatcatacttaccttttaattttccttcaaacaagccactattagaatttgtattaccatagacgatatagtcatcatttgctccaggaataattccttctggattatcttttccatctccaccatagcttgaaatatttaaacaagtgccatcctttgaatagtgggcaatataaatatcttctttaccgtatgtctttatccctgtaaaatcttgatcattagtatcaaaggttccaaccgctaaaaaaccatcactaatcgctaaaagataatctcctgttgtcttactattattagcaaggcttgtagtccattcaacttgtccatttgaatcaatctttaaggtaaatgcaacattattttcctcttcatttccaacaataccactatttgagttagtcgttcctgttaatacatacccattatcaatatcactgcttgatatttctgttttatcagtagatacttttttattatgagctctaattatatgattaaaaacatcatctccagttccaccaaaagcttttacccattcttttgttccattttcattaaacttaacaacaaatgcatctttaccaccatgagctaatccttcgagatctccatcactagaactcgaataaccaactgctaaataactaccatcgccatagttagcaactactgaagtaaattcatccattttcttgactgctttatcaccgccagttccaccagctcgattaatccattcaatatttaaatcttggtcaatctttacaataattgcatcgcgatcagtttcaatcttattcaaaccgttcatatctaaatcagtagaatgtgaataacctgcaacaataaatccaccatcgccagctggttgaatagccttcaattcatccgcatcactacccccaacggtaacaaccttaattaaagttccatttgaatctagcttagcgattattccatcttttccccccttattaagattggctaaattaccatcattagactggcttacccctactgcaacataactgccatcattagcttcagttacagcattaaaactatctgctgcactcccacctattaaagtttcccactttatttggccatttttgtcatatagcataacagcaccatcactctttcctttagcctgttcaatacctgttaccttattgccatcaaaagttcctgttgcaataatatcaccattgatcagtctttcagcatcattgactgtatctggagtaatactattattaccattatctccatacatcgtaacccaattagccacattatctgtttcaaccgcattaaccgttatcgagcacattgaaacaatcattcccaatgaaagcaccgatatgagtgctttatttaaattttttcccattttactgtccatttttcctttctctttttttagttagccttaactaacccatattaaaaatttatcacatggaatgattttcgacaattataaatttcgttgcagtaatgcaacatttattacttttagtgcaaaaaacaatgatttcattaactaatcatcgcttttcaataatgcaacaaaatataaaaaacatatcctattaaagaatatgtcttttatattattactgatttgatgaaatcaatcccttcgcacaaacaataaatttctctagtgcttgattagtcactaccccttttttccaaatcaaacacgattgtgaaacaatttctggttctaatagtcggtacgttaaatttggataagcattacttttgaaaactccatcaatcgagattccatagcaaagaccactttctactaataaagctaaatttgaattaatatcataatttaaaatcgtttgtgcatttatctctttacctaaccagtttttgaaagtttctttaacttctaatcgatttgcaattccaagaactaaattagatactacgtgattttcaattgtttcatattctttcaataaatcatcttttttcattaccaagcaccatttatctaaataaggcaactccaggtattggtaatagtctttatcgattggttctaaaacaattgctacatcaattaaaccctcgttgatcttttccttattttgattactaccagccgtataaatattatatttaattttgggataacgttttgagaactcctttaaaactactggtaaaaacttatttccactcgattcaccacatcctatggtaatttctcccgaaatatcatactcactttttctaatttctgctgctgttttatcttgcaaatctagcatttccttcgcacgacgttttaaaattatgccactattagttaaagtaatttgtctactcccacgaataaacaaacgtgtgccataaatttcttctaactgctgtaattgtcttgttagcgtcggttgtgtcaagtgtagtttttgggctgctttagaaacattacctgattcaactactgccaaaaaatattctagaactcttagatccatctttatcaccactttttattatacgagttatttatctataatactattattctaaaactttttgaacgatattaactgtttttttattttttataagggtaataattaatgtaattgtacttaaactgataaatcctatagcattagcaataaataaagctggtaaagcttcagttctcataagactttggattacaatactgccataaggagagataaacacccctaaattgaatccaaccaataataatgaagtagctaacgtagtatttggaatatttgaattattaattttatcaatcaaacttggcataaaaattttaaaaccaaaccccgttaaatatccaccaacaaacgttataactaaattttgacttaatcctaaaattaccattgctaatgctaaaataattaatccaatcgatgtagtaagccgattaaaaacctttaagatttttccaaataatagtcctgcgctaattccacctaatgataataaaataattactaaactagcatcactcgctgttccatatccctcaccagtcattaaagaagcaatcttaatacccatgatcatatataacattgcagccataaaaattaatccaacataataaaccactggcaaaaagccggcacttttatggctttctttttttatttgatccccaccattagccttaatcacatcggctgtttttacctgagggacgaacttaaaataaataaagaaaacaggtattgcaatcatataagcaataaacggagcctgccaattaatctttaataactgaccagcgataaaagtaatcgcaattcctcctgccccttcaaatgctgattgtaatccatacattgatgaacgctctttagcatcataaaaataattgatcatcgataccaatagtgaattaaacagaccaacaccaaatcccaacattgcacgactaatcaaaataatcataaaattatcaattaataacggtactatccctgcaatcataacaattcccagcccaatagtaattgtttgcttatacccaactcttttagcaattaaagaacttgttaaaacggaaatcatcaaaaataatgacggtaccgtcgttaacatttctaccattgataatggtacttgatcaaaatgttgtgccatggccggaatattagcattaatcgctgcagcactccccactaataatgatgctgataataaggcaaatctaagtatttttttatccataataattatcctcctttgattacactttcattataatcaattgcattactatgtctaatacttatattttatttatactattcgttttatgtatagttttatttgaaataaaaaacacatccttaaaagaatgtgttttcaacattacatattccccgacacttaattacttaagcggaatatgtatccgtcggctctttgatatcataacagatatacttagaatgtcaataagagaattagatatctaatcgtgttaactttactcatcatctttctcagctataatttcattattaataataggagcattttctatttttttagcaatatcaagtttataagtcagattatcatggtaatttaatgaaaataaacaagcatatagggtgtttaaaactatactgatagattctaatgatgaaaatccagcaatttttgaaaatgatttttcccttgtcgtaacacgcaaagtaaccgtagctaaatctgaaagactattattcccaatactcgtaatagctataattggacagttattttcttttaatatctgagcggtcttcacaatattagaagactcacctgaataagagatacaaatagcacattcatcaggtgaagacattgcagcatcatgaaatagattatcttgtatagggtgaatataggcttttttatgaattcgatttaatttaaatacaaattcttctccagcaaaatttagatttgacattgtaaatacccgtatctctttactttggtgtaaaattcgtactgctttttgtaatgaatcatgttggaacaaagacaaagtatctttagcactttcaatgtgtaaatttacgattttactagctattgtcataatagaatcttggttactgaacggtaaattagaatcaatattacaaaaatggctatttaaataatttgcttcttctaaataggcgtctttaaattcaacccagccttgaaaacccagcttcttcgaaattctaatcaaagttgatggtgatgtaaatgttgcatcagcaatcattttaacagaatagtctttaatattaatctgtttatctagaatataatcaataattacccgttcattatgtgaaaaggggtaggctttcatttgttcttttaacaacatcatcattacctcctaatatcttcattatatagaatgagaatattatttacaaattttaataaatattgactattaattgtgaacattatgcctaaataatatttaaatatttaatcacgttcatagctgtgatattttgattatattattaaagggggcaatttaaatgcagtatcgaggtagttacttaagttatttattaatgtatttattctattttttatcactggcgttattatcaggcctgatttctgtttatctgctagatcgtggatatagtgcttcacaagttagtctggtagtagcatcttcatacattgtttcagtaattttacagcctctagtaggctatctaaatgatcactttaacttaaaatgggtaaatagtgttgttttaattattgccgcaattttaggaatagctctaatttttgcaaaacatctttttagtattactttattgtacagtcttactttagggctctttaacagcactaaaccggttattgaaagaatggccaccttatctaaatatcaatatggaaaaattagaatctggggaacaattggatatgctattggttcacaaatcggtggtcttatatatcaatacatttcacctgaaagtatgtatttctttttttctattagcctaggaatttgtcttctaggtattatcggtactagaaacgaacataaaaattctgatattcatggtgaaacgactacacaacacctaggcttatggaataaaaactttatcgtctatttgattatagtttgcttattctatgcgataactaacctaaatacgacctatttaccagcaatgtttcagcatcaagggatttcagttgataaggtttctacaattattttattgattactatttcagaattaccaattatttattattctcatcgttttatgaataacatttcaaatcgtcatatgttaataattgtttttatcttattaatcattcagtttggtacatattgttttattccttataatatcatacatgtgattatatctatcggtactaaggctgtatcaaccgtaatctttattatgctcaatatgaaaatcgttgtttctatagttgattctgatttacagatgagtgctcttgcatgggtttctacattcaatagtttttcttcaattgttggtcaaggtcttggtggaaaaatacttgatacttattcttatactgatttttacttaattttatttttaatcgctgtaattggtctaggaatttcttacttttatcatcttccttctgggcgtaaatatcatcttttctaaaataatttgtaactaaaaaaagataaaaggatataatcttaaaaattatatcctttaaatttatccaaatagacgactctagtttcattaagaaacacaaaatattatttatcaaaatcaaacatttcaaagacatcagaaactggtaaacagttttcaatgttttcgattgttttagcaagtaaacctgctacagaaactgtctttaatttagggaacattttatcttcaggtaatttgattgtatctgttacaacaacttcatcagcagatgaattttgtaatctttcaactgcaggtccagagaatactgggtgcgtacaagcaacatgaactgatttagcacctttttcttttaacatctcaataccagcaacaatagttcctccagtatcgatcatgtcatcaaccataatacagttcttcccggatacatcccctaaaacacccatgatttcagccacgtttggtttaggtcttcttttatcaataattgcaactggggcatctaaagctactgctaatttacgagctctagtggcaccaccatggtcaggagaaaccacgcaaatatcttccatatctttcttcttaaagtagtttgagataagtggcaatgcctgcatttcatcaactggaatatcaaagaacccttgaatttgagctgcatgcaagtcaactgttacaactctagttacaccagctacagttaataagtcagctactaatttagacgtaattggttgtcttggtttagccttacgatcttgacgagcatatccaaaatatggaatgattgctgtaatttctttagcagaagctctttttaaagcatcagctaaaactaagatttccattaagttttcagtgaccggattagaagtagattggacaataaagacatccttaccacgtactgattcatcaatttcaactaagatttctccatcagcaaaatgatgcactttactttttcctacttttgttcctaatttttctgcgatatcgatagctaattcaccactagctgataatgcaaagacagttattttatttttcattttcttctcctattttcctttttgatttcttttttcttctaatactttggcatatccatctttattaacttggcgagcccgagcaattgcaaaagcggaatcttcaacttgatctgtaatagttgagcccgctgcaacataggcattagcaccgaccgttactggagcaactaaattactattacatccaatgaaggcattgtcaccaataatagtttggaatttatttttaccgtcataatttgaagtaattgttccacatcccatgtttacattacttccgacagttgcatcaccaacataagttaaatgtgatgctttacttccttttccaaagactgcttttttcatttcaacgaagttacccatatgagcatcttctaaaatatggcagttagttcttagacgagcaaatggtccaatatctacaccattttcgataatcgaatcagagataactgagaatttaatttcaacattatccttaatttcaacattatcaaattcgcaataaggcccaatatggcaattgctgccaatacttgacttacctttaataatacatcctggttcgattgtcgtatcagcaccaatcgttacatcaactccaatataagtattattaatatcaataatgttaacaccatttaataaatgttgtttatttatttttaattgtaatgatttagttgcttccgcaagttcaacccgatcgttgattcccccaacttcagctaaatcagcaattttatatccaccgactttaagtttatcattattcatgatttctattacatcagtgatataatattcattttgagcattatcattagttactttttctaacgcttcaaatactgcaatgttatcaaaacaatattctccgcagttcatctcactaatttgaacttgctctggagtacagtctttaaattcgacaatccccgttacttgatcattatttctaattacacgaccaaattttttatctaaatcacaatcacatgtcatgatcgttccttttaattggttatcgttatgataagcaattaaatcttttaatgtttcactagtaattagtggagcatcaccatttaacaccacagttgttcctgctttacctgccaaagcatctttacattgcattaatgcatgtccagttcctaactgttctttctgataaataatatttaccccgtctaacagtttttcaacttcttctgctttgtgaccaacaattacgtagatttcatcaacaccaacttgtttcaattcatcaacaatatgattgatcatcggcttgtataaaacctcatggacaacctttggtttatctgacttcattctggtacctttaccagccgccataactaccgcataagttttcattttcacacctcttcattaacaacaacataataacaaaaaatttacatttgttaaaggaaaaaaagataaaatatgtcgtaaaattgaaaagaaattgatttaatcaatttcctcatcattcaatatttctgttttccttacaaaataatattttcccttaaaatacttcattcccttttctaaaataatattattacgtgtcaagccaaaaacacacgatccacttccagacattaaagctccatcaaatccaattttcatcatttcctctttaatcttagcaatctctggtaccatcttgattgacggctcttctaaagtattttgaagattgtcgataactatttgataattaccatcttcaattcctgtcgccattaatcgacagtcttgatggctagctttacttaaatctaaactagtgaatgattttttcgttgatacccctcgtttaggtttaactaataatactttacattcaaaagaattctttataaattctaatttttcaccaacaccactaactaaagcaattttttgataaatacaaaaaggaatatctgccccaacttcttttcctaatgcagccatttcctcattgctcagatttaaataaaataatttattcattgctttaattaccgccgcaccatcagcacttcctcccgctaaaccagcttgagtaggaatatgcttataaacaaagatcttaaccccttttttgatgttataacgttctttcattaaagcaacaaccttatacataatatttcgttcatccgtgggcatgattttgctatttgaatcaatttcaattccgctagcaatagtattaatatagattaaatcatgtaaagtaattggagccatgatcatttctaattcatgatatccatcttctctttttccgattacatcaagtgctaaatttatttttgcgtatgcttttactttcattacttcacctacttgtcggatatatttttcgtgctactcctcttgtgtcgatccctccaacgcctaaatgcttatttgaagttttagccacaattttctctaagtcaacataatttttgatactcgcattagcaatctgacttactacaaaaaccggatcaagcgcatgaatattttttctgcttggactagaagcaaaattagctccactagctaataaaagctcatagtacgattgacacgctccagcaaaaataatcaaactatctttgtcatcctcatacaaacgtgctcgacgaattgcttctacaaaatctttagtatgcaaataactattaatatctttgcgattaccatttttcttcattgcatcatgaccggttatcaccaataaattagggcgatgtttttctaataaaggaataatttgatctttaatttcattttctttcataaaatagccatgaacattgatattaaattcttcatattttttcaaacacatgtcaagataatgtttatctccatcaatatgcagcacactaccttttaaacatggtcgactttctactattatatcacttttctcactactaaaatcacttaattccaaatcactctcatcactatcagctactaaccgatattcaattccagtcaaataataaacatcatcttgaatatcggtaattttaaaacagatatctttgccatatttttttcgacagacaatatcaccaattttcatttatatcaccatgatattatatgtaattaaatcattttggtgatatttttaaaatccgctaattctaattcttcacttcttttttgattttcaattcccgtctgcaataaaatttcttcagcttcctcataactttgctttaaattatttaaaatcgtttttcgtcgctgtttaaaacaaatatttaatacttcatataatttcaaatccggtgctttttttaactcaatttttaaaattgctgaatcaacatgcggagcaggcataaatacatttttattaacagtaaataagtattcaattgtccccatatctttaatcatcaataataatggatttttataaatacccgtcatttttaaagctacttctttttgaaccataacaatcatttcatcgattccaaaatttcctaacacaactttttcaattattgccgttgtaatataatatggaagattagcaactaaacatactttttgatatctttgctttaactgatcaacgatcggtttaatatcctgttccataaaatcaccaaagataatttcaatattatcttgatttaaaaactcctgatacacaggcataaaacgctcatcaatttcaaaactagtaacttttccactataacgccctaatacttgtgttaatgcgccaattcccggtcctacttcaataaccgccgttgtttgatcaatctttgcactagtcacgatcttatttattatatttacatcaattaaaaaattttgaccatatttctttaacgcattcaaatgatatttttctaaaatatattttgttgtcgagggagttgcgatttccttcattactgattcaccttgattttaaaaatctttcctgttcttttaaattcaccattatcacttagtgtttgatacgacccaatctcctcacccaaacgttgataaagactaaatgctttagaatgtgatgactttaaatacaaatcttctttatcttgataatgaggaataattacatttcttaaccaataattcccatttcctcgtgcctttggtgaaatatggaaataattaagaacaattgcattagccccttgttcaaagactggtttatcaaaatattttgaagaattaatattccccgttgttaccatcgctaaaccaacacattgatcatacttatacataacatgataatcaacattaacattagggtcatcttttaaaatatgtactagctgattacaatgatatacttcatcatagtcatcataaaaatcacgatacttcacttttaaattatcaataatcgggactagatattcccctttaaattcattacttactttaaatgtataaccattatgtttacctagatccatcatttaacctccctaacacctgttctttagtgattccaaccatatttaatcgtttaaaaagtgttttgacattcccataacccaaattaaatgcctcatacaccatcaatcttctttgcttattaccaataatatctaaagcaacaaattcactccaagtaatgctttctcgattaacatcaaaagaaactacattttctaatgcttctatcacagcttctttattagcttcagcaatacctaatttcttcttacctctagcatcctttttagcaacaaaagcatgttgacagttagggacaactgcttgaatttgatcacgaatttttttccctggaaaatcagggtctgtcaaaacaataattcctcgacttttacttgcttcttgaattaattctaatgtttgttgatccaatgctaatccgtgtgtctcaatcgtatctacttcaaataattcttttaataaggctgtgtctgttttaccttcaacaacgactatttctttaatttttttcataatttcacctaactctaattataacgatatttcacttaaaataaaaggtataatcttggggctacccataataacgattttatctaaccaatataaatcaacaccataatattctttttatacaattaattaaataatcaaaaggacaattcaatgaaaggattaactaatagttaaagaaaatggttctagattactttttgtgcaaatagcattaaggcagttcgttaccgaatcctgcatagtgtctttggtgctttagatactcgagacgccacagaaacttacgtaatattatctggttgaaaaaacaaactatcgatccctagtgatattttaataattccccaatcacaatacaatatccttttcaaattattaaagctactgtttttaattgtacagcaataatgagttatattatcataaaaagctaatcactatgttaaatacaatcatgacaatacttcaagctaaaggttaacataccaaagaacattgcatttgagttcaaaaattagcaatgaaagttgctcatgagttaaatatgtctgataccagattaaataatttcttccatacttcacaatattgaaaaattaatattcctacaagtattctgcttaaaacaggtcctttaacaactgctgaaaaaaatcataaatactctctagaatcctataaaatgatcaatgatatttttggtaaagaaattggtcaaatggttttacactaccatgaacagagcaacgactcagattacccatttctatcttgattgtatcaacgctttgatcaagtcttaaaaaagataaaattatctaattgacatcatgataaaattacgttatgcttgatgtgcaaacttaataaaccgcttaaataataagctatagcttttccacgtttctgagttataaacgggaggttatagcttttttttgcgaaggaaggagaacttatgaatcaagaatatgatatgatggctcacaagcccatcttcccattattaatgaaaatggcaattcccccgatgatttcaatgttaattcaatcaatgtacaatattattgatagtatttttgttgctaaattgggagaggaagcattaaccgccttatcattagcatttccacttcaaaacctgtcattagctttttcagtaggtctcggggtagcaattaacgcattgattgctaaaagtttaggtgccagtgatgaaaaacaagctaattatattagtgatcatgggatttttttagctattcttcactctttattatttgtttttattggtatctttttaatgaaaccgttctttttgatgtttactactaacccaactgttttagattatgcaattacatacgggtcaatcgtgattacctttacctttggttctattattcatattactattgaaaaaatgtttcaagctactgggaatatgatgattcccatgtttttacaaggaattggagcaattgtcaatattatcctcgaccctattttaatttttggaataaacggttacttagagtttggggttgctggagctgcaattgcgacaatcatcggtcagatgactgcctgtttactagcaattatcttatttagaaaaacttcacgtatcaaagtatctttaaaaaattttaaaccaaatgcacaaattattaaaaatatctattcaattgcaatcccatcaggggtgatgacatcattaccatctatcttagttgctttacttaatagtttgttagcgacagtatcacaaacggcaatcgctttctttgggatatatttcaagcttcaatcatttatttacatgccagctaatggattgattcagggaatgcgaccattaattagttataattatggagctaggcattttgatcgtgttaaaaagattatcaaagtttcaattatctctactgcggtgatcttatgttgtggaacaattatttttatgggattgccagaattagtcctatcatggtttaatgcaactgaacaattattagaaattggtattattggtcttcgagtgatttcaccatgttttattctttctacaatgggagtcgttatctccggagtttttgaatctttaggtaagggacgtcaatcattgacgatttcactattgcgacaatttattattactttacctttagcctatattttattgaaagtaatagggcttaatggaatttggctttcatttgttattgccgaaggaattgccagtgtcattgcagtaatcttaataaaaaaagaacttcataactttaaggtggattaacgatccacctttttaataaatatccaccggctaagccggtggttttacatttgcgggcatagccctgctctcagagcgcatgtctcaagacattccttatgcctacggctaccgcgtgcactctgtatttatttagtttttcccttttccttttttaaacgggtattccaaatccagtgtcagctgttctctttcctgatcttcttttaattgattcgctatataattttttattcttttcgcattctttcctactgtatctacataatatcctcgacaccagaactctctatgtctgtacttatatcttgcatttgcccatctttcatatatcatttgactgctctttccctttaaaaaccccataaaccctgaaacactatatttgggcggtatttctactaacatatgtacatgatctatgcatacttccgcttctattatatttacgcctttccattcacataattgtcttagtattgctcctacctctaccctttttgcttcataaaatgctcttcttctatattttggtgcaaatacaatatgatatttgcaactccattttgtgtgtgataaactatgtaagtcatctgaatactgtttattcatttgtcatttcctccgtgatatcttatttttgcagttggtagccgcatttatattatatcacgtgaggtttttcattatcactccgctaaagctttttgagacccccagcctagctgggggttttattgcagacaaaaaatgaagatgattatttatcatcttcatcaaattcttgataatcgacatcaattatatcatcactaccacgacgatactcttcttggctataataagcctttttcttttcttcagtttttctttgaaattctttgttatattcttctaactgtttagtataaagatatctttttatcgctgaccaaacaactaatatcgcaataattatccaaacaatcggattagtaagtagatttaaaatcaaacttaagataacaataatgattaaaattatcaaaatcacataatacagtggcatcaaatcaactcctttatatatagatataatacacgtttatcatttaaaatcaaataattcttttaggtttaccgcaaaaccattagctattttttcaattgatttcaatgaaacatttcttgttccacgttcaacatctgatatatagttctttgataacccgcaacgaaaagccaattcttcttgagaaatattttgcttcaagcgcaattctttaatacgatgaccaaacttaacttcaattttatccattttaatcactctccatttggatcaatcgtttagcctcttcacttattttcttaaatcgatgatgcaagccggacttacttattgtttgtccagtttcttcataataaacttcagtcagctcatttaatgttaattcaggatatttttttctaattaaagcaacagcacgtgttttttcatcaagcatgtctaaaccaagaaacatatctaccgtctcaatatcttctaattgtttatttgctgttgccattgatttcatttcattagcaatatcacaattattccagcgatttacagtatttgacatgctgcgatcaattcgagtactttcaaaattcattactgactggctcgctccgattgcccgtaaaaaatcaccaatcttttctgaagactttaaataaactacatacttattacgacgtttaataatctttgcatttaactcaaaccgattaattaaatcagcaataaactgagcaaattcttcttcattaaaactcatttctaaatgataatttgatgtttcaggattattaacacttccacatgataaaaatgcccctgctaaataagctcttgtacaacattccttttcaataatcttgggattaggaatctgattaaaccccaaaccatccatcaatgataaatcatctaaaatttcccttgctttagtaacctttaaaatataaacattatttttctttagtttcatttttcttgaaacaagaaattcgatctgaggatcatactcttcttttaacattttatgtatttttgatgcaatcttagcattctctgttctaatcgttaaagaaagaccatgatttgatagcgataatgtcccattgatcttaattactgcacataacattgctctttgacaacatgattcaaaatcattaaaaactacttcttctttgacaactcttgaaaaagataccatcttaatccttaatgatctgcatcacggtgtaaccgatgaacttgataaactttactgtagtgatcagcaaaataattagttaacgaaactgaacgatgttgtcctccagtacagccaattccaataattaaatgcatcttaccttctttttcatattcttttaataaataatcaaataaaacagtcatcttttcaataaagacttttgtttcctctttatcaattacataatcataaacagcttgatcatttcctgttaaatgacgtaattcttcaatgtaaaaagggtttggtaagaatctgacatcaaataataaatctgcatctttgggtaccccatgtttatatccaaatgattcaaaggttattctaaatgggtcaattttccctttactaaaataatcttctaataaattttggaatcttgctccttttaattttgttgtatcaattactaaatgtgctaatcgtgaaatcggctctgctaaacgtcgttcaaactctattgcttcaattaaagaagacgctttatttgaaatcaacaaaggatgagaccttcttgtttctttatatcttttaactagaacttcatcatcacaatctaaaaatacgacagttagatgaatccaatctaaatttgataataatctaattgctttaagtgcatcatccaaacttactgccatcgctactctttggtatttgggattatcctgcactaattccgcaaattcagtcaataaggcaaccggataattatcaatacaacggtatgccagattttcaaaacaggccatcgcgctagtcttccctgcacctgacatcccagttacaattactatttctacttgatccataatcttcacttctctttctatgaacattttaccaaaaatacactgataagtgtactttatttaaaaagttttaacaataattatcgacatttttgcaagtatatttatgctttgtaactcatatatataattatttgaactgatactaattttaagaaatattaatagtcgaaagatgtagttatatgatacaatttaattaaatacagaggggtgaggctatggataaaaaggataagatcgacactttaattgatcaatacttaaatttttaccagcatggcagccaagcaatcgaaccgcagcaaagtactgattttgacagcttaatgaaccagtacaagtctaaatttgataaacaaatcgctaatgagcaaaaagcaatcagagaaaaagaagaagcacgagttcttcaaaaaaaacaggaagcgaaactacaaagtcaaaaaagaaagacccaagaacaacaaaacaagttgcgtaaagagaaattgcgtaatcattccaaaaaaactacggcagaagttaaacaagccgcaaaaaaataccagcaccaaagtcgtgattatgataaaagcagtaatcataaagggctaattgttttaattataatagttgtcgtctttgggttaatttattttattgcctctaatcaagataatgaatctactaataatacctatttatataataatttaaattatctagtcaatgatgccgttttgcaagaacctagttcaaacgatttgagctatctggataatattgaaaataatgaaaattacaatgttgctatcacatatttaaattatgttgaagatggcttaaattatcttgatttaattagtgttacaagaggtaatgatgatttattagaaattaggaatgattctgagtattatttgtatatcaagtatcttgacaatggctatacaaataatgttttaatcgttcctaatgatacttattattgctccattatcgatgaggaagaattaactatagagactattgcattttataattttgaagatccggcattagatgtcttcactaatttatcagatattgatatctatatgaatgttgatagtattgattttttagaaacaaatgcggaaattttatttaaacattattattatcaagcttatttaaaactgccatatgatgacattatggtcatcaaagaaagagattctaataagggatattatggttaccttgattatacaaatcgccaaatcaaagtatattactctgataattatactcacgatgtaaccattgaaaatattcaaaattatcaaagtgattatcttaaaaccataacactttagaaaaggggagaaaaaatgatttcagataatttctttacagaacacatgactattgttattgctgtagctattgttctactacttattattattttattgacatgctggaaaagagttcctgctgacaaagctttagttatcaccggattaaagaaacgtgttctaacgggtaaagggggtattcaagtaccatttcttgaaacatcttgtatcatttcattagaagctgtttcaatgaccactgatatcactgaagcaccttcaaaacaaggaatttttgttgatattgctggtactgcagttgttaaagttgacaataatccagagaaagtattaatcgcagtcgagcaattttgcagtggtaatgctgatcgtactactcaaaatattaaaactgtagttgaacaaatcttggaaggtaaacttcggggaattgtttctacattaaccgtagaacaaattaatgaagatcgtgtcgcattcgaaaactcaattgaagacagtattacacgagaattagataacatgggattacgtttgttatcatatacagtattaaaaattgctactcaagggggatatttagaaaaccgggcaatccctcaaatcgcccaatcaaaagcagatgctgatattgctagcgctgaaagagcaagagataccgaagttaaaactgctgctgcagtacgcgaggggcaaaaagctaaattagaagctgaagcagaaattgctcaaagtgatcgtgataaaacaattcgaatggaacaatatcgtgccgaacaagataaaatcaaagccaatgccgatgtttcatacaagcttcaagaaattgaaaataataaaatcgttgctgatcgtaatgttgaattagcaaaaaaagaagcacaagtagttgaagaacaattagtggcatctgtaaaaaaaccagctgacgctaaaaaatatgaaactgaggttcaagctgaagcaaataaaataaaatcgattaaagaagccgaagctcgagctcaagcattaaaaatcgaagctcaggcacgcgctgacgccaaattattagaagctaaagctgaagccgaagctattcgagcacaaggggaagctgaagccgaagctttaaaagctaagggaattgccgaagccgaggccaaagaccgtttagccgaagccatggaaaaatatggtgaggccgcaatgatgtcaatggtagttgaacgtctcccagaaattatggcacaaattgccaaaccaatggaacaaatcgacaagattactgttattgataacggtagcggtgatggcggaagtaaagttagtaaaattgttagtgatgttgctgctaatgggtttgaagttttaaaagatctaactggtgccgatttaggtgaagttgttcgtactatcgctaataaaaacagtgataataaacctaaaactaaataaacttaattattcctctttaatgagcatttgcttgttaaagaggtctttttatgaaaacagtgaaacactgctattaaatcagtgtttcactgtacttttattaaaccttcctgctagtttttcaagcatactttttgaaataccaaatttaccacataaaaaatcctcgatttcttctggacttttccctgctaaatcattttcatctattcccattgatgacattatactcttaactcggttgaacatctcactatcaccttgttgatacttattcatcatatcattataaaactgctgagcattatctatcttttgttcttcttcaatatttttttgattaaattgattttgacattctaataaaccatcaatttcatcactatctaaccctaatacatcaaaaaattcaagtgctcgattacaaatattttctaattcatattgataatcttcatcagctaattgctgaaccatctctaattccttataaaactctttgatactattgttttgagttggagttaatacaatatcttcatattcatcattttcaagatcatttaatacaatcctcgtataatactctactttttcatgagtatccatgatcatctctatttcaataccagtaatttttgataacattgtaacgaatactttagggtcgattacctggttactaaaagtatatgttatctcctctaatttgataatagctttgattattgaatcattacgatgtttttccaatcctaaagaaataatcttttgatattcaattatcccagcctgaccaaacttaaaatatatttgtgctggagtgatgatcattcctcggctgccatcttgttctttggtagcatcaataaatgcaaggatttcaaaaacattataatcaccaaaagtataaattgcattactaatttgattaggaagattctgatttgaataaaaagaaccattaattacaagactatcattaatataacttaatatttcttcttgactcatttttcttacctctcttcatactgctaccattttactaaaataaaaagctattttcaatcgaaatagccctatctaaactaaactctttattactgccctgatttctttaactcgtttagcttcgaattctggatatgttttaaaccagcgccgattcaatggtgaaggatgcggaagaacatatgcaggtttcccattaaaaacttgatcattaaaaatcaaatcaacaaagttttgattaggaaatattttcttagcggcataactaccaatgatgatataaatttggttatcaactatgtcaatttcttgccttaaccacttttcactacagcattttggcggcaaacgatccccaccgcttttagatttaccaggataacagtgagccaaagaagcaatatagaaattattttgatcataaaatgtttcatcatctatatcataccacttctcacgaagttttttcccacttaaatcattaaatggttttaaagtattgtggacatttaatgaaggggcttgactaatctgcatgatcttagcattaggtttgccccagacaacaggatgaggttcatatccaaattgtctttgacaatagcgacactcttgtattttttgttttaactctccaaaatctttcatctaatcattcctttgtatatattttaacctaattattcccaaaaaaaaaaagattactaactatatagcaaccttttctaatccaaaacgtcttgaaatttcttttgttagtagtgctacaacttgtttatcctctaataatactggggttaactgtcctttaacattttctattgccttcaaaatgtcattttgataatgatatcctggcaacaatacaaaaggaatgatttgttcatattcacctattattttagtattaaacgcacatactgaaccatacctactaagaatatcaaatagtttactattactccgtggatgaattataaataagcgttttactttattagaataaagttgttctaaaagaatctcactgttaaaaagtggtgctgctacttcttttggtgaacacattttagatattttatcatagatctttccatatgaaatgaccattggctgaatctgccattttatttttaacatcattaatatttttaatttatcttgaaaatctatttcctttaaacatagagacatcgcagatacttgttcagcaaagtaatcaatcacattcatacactgtgctgtaaaaattaatagacgtccttctttttctaaaataaacattagtaacatatctaattctgttttttcaaaatacatcagctgcttaaaaaactgttttcgatcatgtttatttaccaaattatttaaaagaaccagcctacgaatattacttaaagcagataaataatcatcatattgttctaattcataaactaattttttagtaaaagctggatactgcccctttgttgatatacctaaaagcagattttccgtttctactaccttcatggcctttaaagatgccatacttgaagtagcacaagcacacaatactcctaattcatcagcatctctaattatctggttatttaattcacgatcatcagttgcaatataaacaaaaaaagcattttgaagatatttaggctgataatctgtcagatacttttctacctctaaagcctcgagctttctatcaatgcgagaagcaattatctttactttagccccttctttaagaaactgcaatgctttacgactagcaaccgcaccaccgccaactataacaactgttttatctttaaaattaatcaaccaaggcatcatgacatttcaccagtgctttttttattgcatttaaagtattgtcgagatcaatttggctatgagcagcacttacaaaccatgcttcaaattgactaggagcaattaaaattccctgtcttaacatttctctaaaaaacaaagcatacatttcagtattacaagtctgaacatcttcaaaagtagtaattggtttattggtaaaaaatagcgtcaataaactttgacaacgatgcacctgataatctaatgataatgtagataaaatagttttaattccattttctaaataatttgctgctttgtttatatattcataaacatcaggatgattatttaaatagcttaattgtgctaaaccaacagacatagctaatggattacctgatagcgttcctgcttgataaaccggcccttgaggtgaaactaaactcataatttctttttttccgccgtatgctccaactggcagcccacctccaataattttaccaaaacaaaccatatcgggaataactcctaaataatctggacagctatgataagagacacggaaccctgtaattacttcatcaaagatcaaaacaattccattttgatcacataatgtacgtaatccggttaaaaactctttagtcgctggaactattcccatattggctgcaacaggctctaaaataattgcggcaatatcttttttattttgttctactgctgctattacagagcttaaatcattatatttgcagattattgtttgagaaattacttcctggggaattcccggactagttggaagattaaaagttaatgctcctgaaccagtcttaactaataaaccatcactatgtccgtgataattgccctcaaatttaataattttattccgaccagtaaagcctcgagctactcttaaagcactcattgtagcttctgttcctgaattaaccattcttagcatttcaattccttgatagctgtcaacaatcaatttagccattgctacttctaacttagttggtagtccaaagcttgttcctaactgactcgcttcaataattgcattttgaacgactggatgattatgccctaaaataagtggtccccaagaacaaatataatcaatatattcaactccatcttcaccaaacaaatgcgccttatcacctttttttgcaaaaactggaatctcaccaactgatttaaaagctcggactggtgagtttacaccacctggaatatattgacaagcttcttcaaatatttcttgattagtcatgatgatcaccttgccatttttgagctaattcaagtgcaaagtaagtgataatcatatcagccccagctcgttttattgctaataacgattcctctattactgcttctttcattattccctgcttaactgccattttaagcattgcatattcaccactgacattataagcgcagattggcatattaaaactaagttttgcctccttgattacatcgagaaaagctaatgccggctttaccataataatatcagcaccttcatctatatcagcttgtatttctcgcatcgcttcattaccattagctatatccatttggtaacttgaacggtttccaaatgaaggagcactattagcagccgctctgaatggtccataataagaggaagcatatttagcactgtaacccatgattggtaaatctttaaatcccgtttcatcaagtgcttttcttatagcaagaatttcaccatccatcattgcacttggagctaccatatctaccccacttttagcatagcttactgcaatcttgcctaaatataataaagtttcatcattaatcacacaaccatcacgatccaagatcccgcaatgtccatgatctgtatattcacacatacaaacatcaccgatcacatacatttctggagcaatttttttgatttctctaattgctctttggatgattccatcatcattgtatgcttcagtccctaattcatctttatgttcgggaattccaaaaagaatgcacgcattaattccagctctctgtaattctttaattatctcattaagacggtcaatagaataatggtatattccctctaatgaagatatctcttttttaatattatttcctgcaaccacaaatattgggctgattaattgctccactgataaacgattttctttgatcaaatttcttggtacctttttattacgtaatcttcttcctctataaaacattaatattctcctttataatcgcaatcattccttcataactattatctttagcttcaataatcttcacatgcggataatattttttaagcgcctgagtcgtcattggtccaattgacaaagcaatcttaaaagtacttggatattttgctaaacgttcaactgatgaagcacaagtaaaacaggctaaatgatatgactcttcttcaacaattattaattctttattttcataaacaattaattcatgatcttctgctcgtttttttatcttactatgttccttagcacgaacaataatcatttcttcactatccatccgtttattttttaaataattattaaaatcttcactatttgctttaggactaattaaatcactataatatccatatagttgtaacaagttggctgtcttttcaccaatacaagcaaaacgaactgttgtcaaactacgatgatcaaccctttgcatctttaaataattaaaaaatcctctaataccattttggctggtaaaaacaattaatttatgatttaaatctaatttttgctgaaaattcaggtaattgatcttccctaactgaacctgtttaactgccgctccctgttctttgaaatacttactgattggtaattcttgatcactaacacatgcaaccagtatctttttgtttagtagtatttttctttgaaaaaaatctaattcatgatgcagtgccactactgcaccaacaacaatcaacataggtgagcacaaacaactatctttaaatttatcgataatattttctagtgttccataaatacttcgctgctctgttcgagttgcgttggaaattaaagcaattggagtagtcttatcttttcctgccaccaaaagatttgtaacgatttgttctagtttttgttgtcccatcataaatatatacgttaagctatcatctagaaactgttgataatcccattcataagcttgattatttttatggtgagctgttactaccataaatccagaagataccccacgatgtgttattggaatacctgcataacataaaccagcaacagctgaagttaaacccggaacaacttcaaagtcaattcctgctttgaataaagccaaggcctcttcgccaccacgaccaaaaacatagacatcgccaccttttaatcgaacgacttgtgcatattgtcgagctttttcaattaacagaagattaatattatcctgagctaaagtatggttatttgaagctttacccacatagattttctcacatgtttccttacaataatttaatattgcgggatcaattagccgatcataaattatacagtcagcactttttatacattcgagcgccttaactgtatataaatcgattgctcctggaccaccaccgactaaatagactctaccgttcataaacttccctcattaacatttcagcaagtgctgttacttcctcgcttgcatcttttaaactaaatttcttatcaatgttttttaaaaccgttccatcttcattccctaacaatccgtaaaaatgtacctgatctccaataatttttgcataaccgccaacgggaatatgacaactgccatttactgtttttaaaaataaacgttccagttccattcgtgttgttgtaatttcatcacttatattattgatcatcgtcaataattcactatcttgacgaacttgaattgctaatatgccttgaccgcaggcaggaatcatttttgtctcatctaaatactcactaattaaatcttccaagcctaaacgttttagcccagcacttgcaagtactagaccatcgatttcttgatttgccatcttttgcagacgagtattaacatttccacgaatatcaacgatttttaaatcagggcggagttttaatagttgatattttctccgcttgcttcctgttgcaatcgttgcatgctgaggcagccttgctaatgaagaacaattctttaatactaagcaatcacgataatcactaggagctaacgttttagcgtatactaaaccagcaggattatcacttggcatatcctttaaactatggacagcaagatcaattgtatgctctaatagttctttttcgatttctttaacaaaaacacctttatcgtttattttgtccaaagcaatatgttgcattttatcaccaatggtatgaatgactttgatttcgtattcattttctggatatgccctttggagtttttcaattacatattcagtttgttttaacgcaagacttgagcctctgctaccaacaattattttcattcttcattatcctctttaagactaaatagtttatttattacttcaagatcattgatttgattagtttttacacaatgtatcggatctttcattatttgcataaatgatgcttttaatgttttttctaatatatggcgctcacgagcagttaaagatagtttattaaccaaaatttcataagtttgattagctaactgcatactttttgcctgtaaagattgtatcacataatcatatttgatactatcaagctttgttcttacttccttgatcttaatatcaatttctgaatttattttttctacatctttacttcgtaattgattattgactgcaacctcatggtttaatgtatctaaatcaatacattgaatagaagcagttttatcaatatcacgaggaatcgtcaaatcaatcgctattaattgtgaacttataaaatcatcacgattaaagattagatgcgggctcgctgtagcacttattaaaatattaacttgatccaacaagatctttctttgattaaagggaataatttttattttaggatactgttgttttaatttaacaagtttgccactatttcgattagaaaaaattaattcattattatcatataaatatgggataaatgatgtcgcaatttcaccggcaccacaaatcataattttttgattatataagtttgatactttttttaaatgttcaacggctaaatgagtcaatgagattgacggctgctgatatttgtgcttcatctttttgacaaaattaagagtttcttgaaaaatcaaagataactcttttccccctaaagacattctacaagtaaaatcatatgcctgcttaacttgtcctaatatttgatcttcacggatcagcatcgattctaatccacaggttacttttaatagatgcctaaaagcttcatcaccagttttaacatataatggcgcctcagcttgattaaaataatttaaataaatagatggtaagaaatcaatatctgtttgatacatcaaataaacttcacttcgattacaagttgataaaataagaacttgttcaataccataggttaataataaacttgaaaattctaatttttgagtatctgtaaaactaaataaggaacgtttatccaatgctaattgcttgtggctaacaccaattactgcgaactccataaacctttaaaaaaccacgaaatcgtggttttaattttgtggtcctgcttttttatgttgttcaagcggttttaaatggatattggcacgttgttcactttcagtccaatacaattcttctgccacaagacactcaggatttaattcaacgccatctaaaatcaattctttaaacttaggatatccagcaatatcaattaagtgtccaccatgaatatattcaggtttgttatccatcacccaggcagaaaacttttgccaattgctaaacacttgtagtaatgcatcttcggtaatccaatttaagaaaattttccccattcttggatactgttttccactacgtccacctagagtaacacgataaaatttagttggtttacgtgtccaggcaccagttggacaagcaataacacactctccacatccaacacaacaacaagtatctttatctactttattatcagcatttagtgaaagtactctagtcgcatgatgttgacaagctcgcacacaagcaccacagccaatacatctttctggatgatactccatcttcgcgatccccatgattccaaaatcattaaaatgaccttttccacaatcattagggcatcccgatactgatactttaatatgatagtgactaggaaaaataattttttcaatttttcttgctaactgatacgtattcacatttgctttgatacaatgagtattaccaatacagctcataacattacgagctccaatagtaggatagccataatcagtaacatccatatcaacatcacacatttcgacttctacttctttaatataatctttaatatacttgtttacttcaccaatgtattcatattttattccgggaatattcaaagtttgtcgcattccaatatgaaatgttccgtttccccagttttctgcgatgtcttgaactacttgcaaatatttagccgcaatcattgatcctggcacccgcatctgtaacatgaattcaccagccactttagactgtctaaaacaatttattcttaatttttttatatcaatatcatgattcatcttcagctactcctaatctactaaatatttagcctttgtataattaaatactggtccatctaaacaaacatatgtttcatcaattcggcaatgtccacatttcccaactgcacatgacatttttctttcaaaagatacccaaattttttcatcaggtacccctaaaccagcaaccttttctccggtaaatttcatcatcatcggtggcccgacaataataacttcataattacccataaaactatcaaaaggaattttttcaactaaatcggttacaaaaccaacattccatccttcaatttggtctttatctaaagtatagaaagtattaaatttttcttgccatttatttagttcctctttaaaaataattccagcctcatttttaaacccaacaattaaagttaaactttttacatatccatcattttcaaagcactcatttagcatacttcttactggtgctaatcctgtaccaccagttattacaactaaatgttttcctttaaaggtttcttctaaaggccagcctttaccatatggtcccctaataaagagaacatcaccaggtttcttattaaaaatttcatcagttacttttccaaccgaacgaatcgtaaaatctaaccagccctcaccctgggctgaaacagagattggtgcttcaccaattttaggaattgataattggagaaactgtccatgttccggtttaatatttgtagcaactttaaacgtatactctaaattactttctcgttttatctcaagaattgtacttggaattggtttgattggattattcatggttatctcctttcacttcaatttccgccactgccgtagccatcttctcaactgttgccgttactgaaatatattcagggcatcttgatgtacagcgcccacaaccaacacacatatgataatcattaaaacgtgctttataatcatgaaatttatgaagaatcttatatcgcattcgatccccagccgttggcctaaaggcatgacctcctgccatatcactaaaaccatcgacctggcatgaagctgcagttcttcggcgttctccaatactagcattttcattataaattaagtctgttgtcgtaaaacatgtacaagtagcacatgctatcgtgcaagcaccacatgaaatacagcgtgaattaaatgtttgccacattgaatgttgttttaattttaataacgtttccttgtccttgatttcaggaactgttacttttacttcattttcctcaataaatgaaacttcaaaatcatctttaggggcttccataaaatatttttcaaattcactttctttaacttctattaatacctcattatctaaatgacgaattgccagactataattgtccgttttattagcttgcatactaacacaaaaacaagtgtcccagccacttgtacactccattaaaattatcttaactttttcttgaagtcgttgataataaagatcactgtacccgccatttcctaaatatattttattttgatgttccattgcattaacatcgcaaggtctcataaaaatcaatatctttttatcagttactttactttcacgatattcatcttctgtaaaatagaataaagattgagtaattggggtaattacttctttagctggaaaatcagatttttgatcaaacactacttcttcaattttactaattttatcatagcgaataatatcagtatctgaataacgcccttgtttttcaaagcgttttggtccatagatatcatattcttgtgatagcgtcgccaaaatatcatttacatctttaaaacctactttatatcccatcgtttttcctcctaatgcctacgcttacattttgattataacactttctatgttattataataatattaatatctaatgatatctattggtttttccaatagcacaggaggtctcaaaatgattacacgaaaacatttagccatttttaaaacggttgctaaaactaaatcaatgtcaaaagcggccaaattattatacatctcccagccaactatttctcaaaaaatccaagaaattgaagatgagtatcaggttaaattatttgaacgttattcaaagacactatttatcagtgaagagggtcaaacattactagttaaagccaaccagatattgaatctatatgatgaaattgaacatatctttactaaaaccaaacaattcccattaaagattggtgcaactttgacaatcggcagtactcttatttcacctattttaaagaaattaaaagataaatatcaagatattacttttcaagtttatattgataatactaatgttattgaagaaaaattattaaataatactttagatattgctttagttgaaggtacgatcatcaatcaagatttaattgtcgaacccgttatcaaagatcgagttgtttttgtttgtgcccaagattaccctctaaataacgttaaagtaatgagcctaactgaattgagtttacatccttttattgatcgtgaacaaggtagtgggacaagaaatcaacttgatgaatgcttaaaaaataataatatttttttggagcctgcttggcaatgtcatagttgggaatctgttaaacaggcagttttaaatggtcatggtatcgccttaatgcctatgaaaattattgaaaatgaagttattgaaaaaagtatccaagttattaatgtcaataacatcagtattgaacgcgatttttcaatttgttatcataaaaataaaagtataaataaaaaaatgcaagcctttattaagacctgcaaaaattattaattatttaagccttgaccaacttgttgaccaacaattgcaccatcattggtagctgtcacaacttggcgaagtactttttgacgaacatcaccagcagcataaatacctttgacagatgtttccatcaattcatttgtaatgatatagccacgctcatcagtaattcctaagtctttaacaaaatcagtaattggatctaatcctacaaatggaaagacacccttaactgctaattcactaacttcaccagtcttactatcttctaatgcaatcgccgcaaccttattatcttttgcaataagatgatgaggtttttttagaaaatgaatttcaattttatcattagcttgaacatgatcttgaattattttatcagctctaaaaacatcccgccgaacaattaaatgtacttttttagcaaatttagttaaataaatagcttcttctaatgccgaattaccaccaccaacaactgctacttcatcacctttaaaaaatggtccatcacaaacagcacaataagaaacaccatgcccggttaattcttcttccatcggaattcccattttacgttccttagttccagtagcaatcaagacattttttgcttcatatgactgatccgttgttataacttctttataatcaccgtaatcaattactttagttacttcaccatatgcctgttcaccgccaaatgataatgcatgttcatacatttcataagctaactcagggccagtcttctttttttgtccaggccagttttcgatttcagcactgacattcaactttcctccaggtgctccagcatccagcatcaacacctctgcccctgccctagttgcatataaacatgcacttaatccagcaggaccagctccaataataattaaatctttcatcttaacacgctccttctatatatggaatgatttccttcatctcgtcgatcattaaatctggttctaattctaataaatgttgataacctttaggtgaccattttacaccaattgttttaataccagcatttttcccagcttgaatatcagttatattatcaccgatatatacagcttttttaacacccaataattccattgccttgactattccttctggatccggcttagtgaccttaacatcgtctaatccaattactacatcaaaatatttttttaaatcaaaagtattgagtcctacatcagcagcaacttttaatttagtcgtaacgattcctaaaggataacctctattttttaaatattctaatgtttctactactgtcggataaacatagacaaaatcctcgtgatgactatggttataactatgataataattcaacaattcattaaacatttcatctggaaagtacttcgaaaacgtttcttttaaagatggtcctaaaaaagataataattcatcttcactcaaagtatacccaggctgatacttttcaaatactttaataaaagttcttttaattaattcatctgtatataaaactgttccatctaaatcaaatattattgctgtatccataaaatctcctttacacatcatagtatatcacacgtaattaaatgtgataaagattatgctttattatttatgaatataagtctatacttatgacgaggtgattaaaatgaaaattgcaattgtatttgatagtcatacaggtaataccaaaaaagtagctaatgtaattaaagaagcttgtattaacgaagaggttgtttacttcggtgaacctcaaacattcagtgacgcagatctgatttttattggaagctggaccgataagggtaactgtagtcaaaagattcaaaattttattactactctttcaaatgaaaaaatcgctttttttgcaacagctggatttggtggttctactgaatactatgataaactggcagaacgatttgataatgttgtaaatactaataataagatattaggacactttttctgtcccggtaagatgcctttatcaatacgtgatcgctatgttaaaatgattcaagagcatcctgaagataaacagcttcaagttagtattgataactttgatgcagctctatcacatccagatacaaatgatttagaaaatgctaaaaaatatgcattagagatgatagctaaggtttaaatatcttagctattttatatattaaaataaatgaattggattaataaaattaatttttttatgttattataatataaaaggagtggtaggatgttgaatggaaaggaattattagataataatacgcatataatttatgaaaaaattactactgatgaacttccgctaaaagttattgaggtaactttagctaaagatgatcctaatttaatccctccaaaacattggcatcgtagtttagagtttattattccacttaccgcatcaattgaactttggagtaatggggaaacttattcaattgctcgtaatggtttagctatcattaattcacaagctatacatacgactaaaattattgaatcagaggattgttttaaaagtattgttattcaaattaagtatgattttctaaaaaaatgctatcctgcatttgataatatctatttttctaatcatatagtcccagaaattgaacaaaaactagtcgttcttttaactaatttgagtttagagtatcaacaaactactgaatttaaattacttactattaatggttatttatatttaattattagtattttattaaagtatcaaaaaaagattagaaaagttggttactttcttcaatctgatcaaaaactccaagaatttatgaaaattctcttttatttagatgaacattattctcaagcactagatgtttcctcaatcgcgaaccaatttaacttctcttatggttatttagcaagattgttcaaaaaacacttaaatattacggtcaaacaatacttaactgcacaacgtttagaacactgtactaacgatttgattcatactaatttaaccattactgagattgcgatgaaaaatggcttctctagtactaaatcttttaatcgtgaatttaaactcaaatatcatgaaacaccccaagtatatcgtaataaagttagaaaatgaccctaatgtggtcatttttttcatatttaaattttataaataagcttaagatataggcaaggtgaaaggagaagagagaatgaaaagattatcaaaattattacttgccttatttattgcttgtagcattaccggatgttctcaaagcacagaagttgttgatgcaacttatgaaatttatattgccggatatgattggggatgtggtgtcaataaaactattttgacattagacaaagctgttgatgatgttgacaaaaatgattttatggtatctgaaacaaaacaagtaactgattgggaagatgaggcacttccagttgttgaaaaaactttggagcgtgttgttgatgatgcctattcttgtgataaagatgggcaaaaaattgatggagagtctaaatatattgcgattgagttatatgtaagcccaaatgatggttcgccattattatactctgctacaacacattataatacatggagtgatccgtattatttaaatatttcattagcaaaaaacggtgaaataacggtagacgataaaaaagttactaaacttgatgttagtacagaatatactaaaaaaattactgctgctgacgctttagaattagaaaaatttaaggctagtgatggaattgaattaaattatggtcattttaaccctaaagaaccttctaatacattatttgtgtggttacatggttctggtgaagggggaacagaggatactaatccacaagtaacctctttatcaaataaagtaagtgcttattttaatgatgatttccaaaatgctgttggcaatgcatatgttttagttcctcaatgtccaactttttggatggatgctgatggtaatggcggtgaatggaatgatgacttattagtaactcatggtccttcttattatactaatgcacttatggaattaattaaagattatcagtctcgatgcggagctactaaagtcgttcttgcaggatgttctgcaggtggatatatgactatgcgtttaattttagattatccagattattttgctgcagcaataccaatttgtgaagccctgcctgatgatgttattagtgaccaacaactttctgaaattaaagatctacctctatattttatttattctaatgatgatcctagtattattccagaaaaatttgaaattcctactattaaccgattaaaaaatcttggtgcaactaatctacacgttgccacatttgattcggtcatcgatacttctggtaaatataatgatttaaatgatggtgacccataccaatataatggtcactggtcatggatctattttgataataatgaagccgactgtgatgaacatggtgaaaaagtttggcaatggattggtgaacaagttaaataaaatgaatataaaagatgtaacggataaatttttaaacgttacatcttttaattataattttcagttaagttgacaattatagggttcctcatttaaatatttttattgctaaaaagtatttctagttcccctattttttagtcttttgaaatatgaatattagataaatctaaatactcctgcttattggaaagaaatcctgatttaactgaaacaaaaccttttaaaatatcatgggcaaattcctctctgccactactgatacctgttttaaacacctaattaatattctaaaatcattttcttattccagtattaattaaccgattgatgtcatttaattatttaacacttccgccatggaataaacactcgtatactttaatattattatagtatatttcctctttaccattaaaaaattcataatcaccatcataactacaatgatatgtataattaccattagtatacaacgccggacctctaaaaggagaaattcgatcaactaataatagtgcttccttcaaaaaatcaccactaaaagcctcatcaagcactttaccataataattcattacataaagtggaatattgtctttatagacacattcttcaccaccaaaaaattcactgcctacaaacgtatcaatatataaatattcattttcttgatattgataatcatggctgttaggtcgactggaaacagttttcccctcctttttagcataggttgctttttttgcctttaacataaaatcaatccagttataattactaattttactttctatttcctgcttagcacagtcattatccttaactaagttatcaatcgttatcccaaatatcactgataatcccatgatataatcgagatttggcagcacactaccactctcccatttagttactgtttggcgacttacttcaagcagatcagcaagctcctcttgtgttaatcctttacgtttacgatataaaataattttatctccaatcattttccatcctcctttattttagtatcattttactatatatttaaaaattttcgagaaactataatttacatttttagcaactattattgtcatcttcaaaatataaggaaataatagtaattatgttgtacaataaattggggtgataacatgaaaaaaattaatataacagaaattaaaggcattcaaatcggccaagtcgaaaatcaaaaagctggaaccggctgcactgtaatcatctgcaaagatggtgctacagctggtgttgatgtaagaggtggcggcccagcaactagagaaacagacctgctaaatccaatcaacatggtccaacagatcaatgctgtaatgctaagtggcggcagtgcctttggactagatgcggctagtggtgtaatgcaatatttagaagaacataactgtggttttgatatgaaggtcgcccatgtccctattgtttgtggtgcatctttatttgatttaacagttggtgatcctaaaattcgtccagataaagcaatgggatatcaagcttgccttaatagcgaaaaaaatgaaccgcttaaagagggtaactatggtgccggatgtggtgctagtgttggtaaaatcatgggtccacaatatgcaatgaaaggcggcttaggtactgcagccatccagatcgataatcttcaagttggagcaattgtagcagttaatgcctgtggaaatattgttgactataaaactaatgaacagttagctggaatttatgattcagaacacaacagtatcattcctgcagacgaggtgatttttcaacaaattgaaaaacttcgccaattaccaagtggtaatactaccattggttgtattattacaaatgccaaattagacaaagctcaatgtacaaagattgcagggattgcccacaacggttatgcccgtgctattcagcctgtccacacgatgagtgatggcgatactatttttgtattaagtactaatgaagttgaagtaatgccagatgccattgggattcttgcaactgatttaatggctaaagcagtcaatcgtgcggtaaaaaaagccgacagcgcctacggtttaaaatcatacaaagaattacataaataattattattacagttggcagcaataataaattgtactataatcttatcgtcaaaccgtatcaagaagatattttcaagagatcatcatgactcttagaaaaatgggaagatatggcgagacactcataataaacatcacatctaaaaagagtgatagtaggaggaaaaaatgagatctaaaaaaacacagtacatgactttcatggcaatgtttcttgctattgaaatcatccttgtcgtaacaccgcttggttatatcccaatcggtcctttaagtgctacgacaatgcacattcctgtaatcattgctgggattacattaggaaaaaaggcaggagcccaacttggtttggtctttggactaactagtttaattcgtgcaacgattcagccgggaattacatcattttgtttttcaccattcgttacagtgggaaacattagcggggattggcgaagcgttataattgctcttgttccaagaatattacttggctatcttgctggagtaatctttgaatttataaaaaacaagtttaataatgaaaatgctgcagcagtgattggtgctttaattggaacgattacaaatactgtacttgtcctaggcggaatttactttttctttggcactgcttatgctgatgcagttaatattgcctatagttcattgctggcaatgttatttggtgttgtgactactaatggtatcgttgaggcacttattggggcggtcgttaccctcctggcatataaagcaattaaaccaatggcaacaaatataaaataatttaaggttaagttaccctttaaattcattactattagtaagaagtgtgttattatcacttcttattttattatagtttatttatacttttggtatttataaaaattatttttacttttacaattaaaatgatagaaacttatcttttcatttagctaatttctataatttatagataaaatagtttcttcttctctttgaggaattgtaaatatgactatatcttttataataaagatatagtcatatcatatagaaaagaggaaaataaaaatggcagattcaaaaattatctttattgatgttgatggaactttagttgattatgaaaacaaattgccagcttcagcagacaaagcaattaaacaagcacgtaaaaatggacatcgtgtgtatatatgtactggacgaagtaaagctgaggtatacccttatttatgggatattggtcttgatggcatgattggtgggaatggcagttatgtagaagatggggatacggttgttatgcatcagttaattactgctgagcaatgtaaacatatcgtagactggttaaaaagtcgaggacttgaattctatcttgaaagtaataatggtttatttgcgagtgaaaactttgaaactcggggagaaccagtaattcaagaatatagtaaacgtaaaggtaaagaacatagtgatcaaattaaagttcgagatgtttttccagaaatgatttttgatggtgaattatatcgtgatgatttgaataaagttagttttattcttgaaagttatcaagatcatcttgattcaattgaagaatttcctgatttaaaagctggtacatggggcggtgcaggggaaattgctctatttggtgatttaggcgttaaagatattactaaagctcatgctattgatgctttattagagtatctaggtgcagatattgaggatacatatgcctttggtgatgctaaaatagatattccaatgcttgattattgccatattggtgttgctatgggaagtggtggcgatgaaatcaaagctatggctgattatataactgatgatgtcgaccaagacggtttgtataatgcttttgttcgttttggtttaattgaagcagagtaaaaaataaaaaccacgcctaaaagacgtggttttctctgaggctataagcctatgttgcttgctcgcgtctcaaggcgctgctttctcttcgttcaagctatcgcttttgactctcgccatccctcaaagggatttatttcctcctttctccttttgttatcttcttctctcttttttgttttctttcttcatttctttatcttcaaatggattttgatattcttttacactcaatttatccattgctatatcatgtccctcttgttcccttatatattttgcgactgtttgatcatttagtcctactgtactcacataatatccttctgaccaaaaatgtctatttccatatttatatttcaaatttgcatgtcgatcaaatatcattaatgctgacttacctttcaaataccccataaatgatgatacacttaactttgctggtatcattaccaacatgtgtacatgatctgacatcaaatgcccctctataatttccacccctctatattgacataatcttattattatttctcttatatcatttctaagttgattatatatcacttttcgtctatactttggtgtgaagacgatgtgatatttacacatccacttcgtatgtgccaatgaatttgttttttgtgccatacttaatcacctttcctttcttataatgacagcttgaacaactccattatatcggaaaggtgatatctttgtataacttctttattgctccacccgcatagcaggtggttttttatttcgcatacttcgtatgctcaactgacttaagtctatatgttcaaataatataatgaaaacgaagggaatttttccttcgttttcattatattttttataatatttctatcaaatcattctattatataattattcttaacactaaatttataagaaaatcaataatttatacagctttatcaaactgactattataaagctctgcatagaaaccaccacgacttaataaatcttcatgatttccactttcaataatatcaccatctttcattactagaattaaatctgcgtttttaattgttgaaagacgatgcgcaataacaaaggaagttcgtccctccattaattcatccatggccttttgaatctgtaactctgttctagtatctactgaactagtagcttcatcaagaatcaacattggtttatcagcaatcatcgctcgagcaatcgtcaactgttgtttttgtccttgtgataaatttacttgatcattaagtaccgtatcataaccatatggaagtgttctgataaaatgatctaagcctactgctttacatgcttcttcaattatctgattagatatatttttagtattataaaccaaattctcacgcactgttccttcaaaaagccacgtatcttgaagaaccatacagaattgtccgtggacatcttctcgacgtaaatctttagttggaatattatcaattctaatttcgccacgatcaacttcgtaaaaacgcatcaataagttgattatcgttgttttaccagctccagttggcccaacaatagcaatcttttgaccaggttcagcacgagcagaaaaatcattaataataatcttattgctatcataaccaaaatgaacatgtctaaattctactccacctttggctttggacaagcgttttactttatgactctcatcagccatttcttgagcttctaaaaattcaaatacacgctctcctgctgcagccgctgactgtaatgattgagctgcttgagctaactgtgataatggctgagtaaaatatctaatatacatcataaatgctacaattactccaaatgatatatctccactcattgctaatgcagcgccaataatgcatactgctacgtatccaaagttaccaataaaactcatgattggcatcattaatccagataagcattgggccttaaaaccactattacgtaaattattattctgtcttgtaaaagcttcttttgccttaacttcaccattataagccttaacaatcgtatgaccagtataaatttcttcaacatatccattgatttcaccaagatgtttttgctggcgagcaaaatatttttgcgatttagacataattaccagcattaaagcaaaacctataaccgttgctagaactgcagtaaaagtcataatgagattagtttttaacatcattataagtgaaccagctaataaagtgactgatgaaactaatgttccaacactctgatttaatgattgtccaatcatatcaatatcgttggtaactctcgataatatatcaccagttgaagtatgattataaaaactaattggcaagcgattaattttacgcgaaatatctcttcttaaatttttagtaacccactgagttactgttgccatgacaaatccctgaaataaagaaaaaaaagcactagtaacataaaatccgactaatgtaagaccaattttaccaatccttgtcatatcaattcccgtcattattccatttgtaattaaatctgttaattctgataatctgtctggacctatcaaggttaatattgttccaaatatggcactgataattgccataaccattacaatccaatactttctacaatattttaacaattttaaccatgtttccttaaaatctttagatttttctttactacccatattaaccccaggagcttttaaatcatttttctctaaatactttccttctgccattattctaattcctcctttgataactgtgaacgagctatttgttggtaaacttgacaattcttcattaagtcttcatgtgttcccatccctacaataaccccttcatcaagaacaataattttatcagcatctcgaatcgtaccaattcgttgagcaacgatcaatttggtagcatcgcaacaatctttctttaaagcttctcgaagtttttgatctgttttatagtctagtgcagaaaacgaatcatcaaaaatcataatttcgggttgacgacatattgcccgggcaatagaaatccgttgcttttgcccacctgagtaattagaaccgccttgggcaacatagctattatatcggcgtggtgaagcctcaacaaaatcagaagcttgagctgtataaatggcatcaatgacattgttttgaagattattatttctaccattatcaccataggcaacattagattcaatagttccactaaaaagaactgctttttgggatacataaccgattttgttatgtaaggcatattgtgtataagctttaacattaatcccatctacgagtacttcaccttctgttacatcataaaaacgtggaactagattaatcactgtacttttaccgcatccagttgaaccgataaaagcaactgtttctccttgagcaacagtaaaagtaatattttgtaaaacataatcttcagcatcaggatatttaaaactgacatttttaaattcaatttgtcctttaatacccggtttagcgacagttactgtaccatcattaattattggtactgtttctaatacttccatgattcgctttgatgaaaccgatgctcttggaaacattataaaaatcataacaagcatcataaaagccataactacttgcattgcatatgtagaaaataccaccatatctgaaaataagtttagtttatccatcatagcagcattttcaatcagaatggctccaatccaataaatggccaatgtcagaccactcatgattccttgaattcctggactcatgattgccataactcggtttgcaaacaagtttgctgaggttaactcctgattggcattttcaaatttattctcttgataattctcagcattataagcccgaacaacacttattcccgttaaattttcacgagtaacccgattcaaatcatctgtcaactgttgtaattttttaaattttggtaatgcaaaaatcatgcaacttcctacaataactaataaaacgattacagctacacccgttgaagctgtccattgccagcttttaccagcaatcttgaaaattgcccaaacagccataatcggtgccttaataatagcttgtaatcccattacaacaagtgtttgaatttgtgaaatatcattagttgaacgtgtaatcagacttgctgttgagaaactaccaatttcttccattgaaaaagcttgtactttatcaaacaatcgctctcttaaattagcagcaaaatttgtagctacccttgctgcaaagattgctacaactaccgatgaagctaaacttcctaatgcacatcctaacatctttacacctgactcaattatttcatccattgtacttcctgttgtttggactagcattgttatttttgacatataatctgggagtttaagatctaaccatacttgtaaaataataaatgctagacagataataattaagctccaatcttttttagtaaagtttttaaatatttttatcattcaaaatctcctttcgctttataagtccatcttaaacaataaaaataaaccaaaactaaactaaaagaactaactttaatctcgttagttctttgcatatatatttgtattacaaattgagaggcaatgttacaataaaagttgtttcatttttattgctatcaacatcgatagtaccactatgaagactaacaattttcttaacgatagcaagcccgattcctgttccctcagtagcatgtgaagtatctccttgataaaatttattataaagatattttttctcttcatcagtaattttaggtccattattgctaattaagatttgataatcactttgattatgaataattttaattcctaatttaccatctcttggggcaaacttaattgcattatcaagtaaattaatccatacttgatacaataactcttgattcccagctatttgatgttcatcaaaatcaataattagattcaaatttttattagaccatttcttttctaataaaagaaggcaattacgaatttgctccgataaattgaaactagtaatgttacttagtattgtctgtttttcaatcttatttagatttaatacattagtagccatatctgctaaacgactagattcagtttcaataatttgtaaatatttatcatgcgttttttgatcaagattatctttttgtaataatttggcaaatcctttaattgatacaatcggtgtcttaaattcatgtgaaaaatcattaataaaattagttcgtaacatttcagtattttctagttcctcagccattgtattaaaactgtctgttaattcctgtgaaatacggtgcttccctaaattaatgcgaatatcatattttccatgagctaactgattcattgcttcaattaatgtatttaatggtctgagtggaaagtgactcccaagtgctgcaactattgtcccaataacaatacttgtcattgcaaagataataatttgaaaatgaattggagccgatgcagtttgtgatattcctaatacaccgatttgtgttaagaaaaatattacacatccaacgattatcatagtaactactaaaattataaatactacaatcgtaaatattaaagttagtaatgctcgtggcggtgcttttttacgattcatcatttcttaccgccttatagccaagtcctctaactgagataatttcaaactctggccaatcttcaaatcgttttcgcaatcgagcgacatgaaccgtgacagtttcccatccagtatcgctatcaacaccccatatttcatccattaattgtattcgcgtgaaaattttacccggatatgaaagcagcttatataaaagcataaattctttttggggtaattcctgacaggtattttttcgcttcactgttagtgaatcataatctaaaataacttcaccaattataattcgatgctcatttacaatcttagcccgccgtaataatgccttaacacgtaagagtaattcctcttcgtcaaacggcttggtcataaaatcatctgttccaactataaatcccttatttcgatcagcaggtaattgttttgctgaaaccattaaaataggtagttcattttgtactctacgtaatatttcagtaaactcataaccatccattttgggcatcattacatctaaaattaccaaatcaatatgacttctatccaaaacctttaaagcatcttcgccatcagttgcacctataacaatataattttctgtttctaaaacagccttgatcaattggcgagtatttttatcgtcatcaacaacaagaatatgaaacatagcctatcacctcactactatatagtatatcagttttataaactctaactaaactaaattatattgtataaaaaagtaatcttattttgccatctctaattacattatttaaaagtaatttgaataaaagagccaatcaactaattttagttaactgactctttttcttattgtctagatttttttctaaacaatgatttcaaccctcgcttgattacttgaaaaaaactaagtgatcgaactaaattttctgagggaatatatttattaatagcacgtaataatgctttattatcgcgtgatgagaaagtaaaattcccattatttttggtaacaacggcaaagcgaggaatccattttcctttaaacataactgaagccattacacaattaacttcttcccatggaatttgaatataatctctaatatttttttcattatagaattcaaatgctttatcgcctatcatgacttctccgtaattagcaagaccaagataagaagttgctttgactgttaaatctactttagtatttaaagattgtaccatatatttcctcctttacagctgccatgtattttctttattatattacattattccaccaagacgtgcaagaattccgataatgaataaagcaacgataataacgattggtgatactttctttttcaatagccaacagcataataatgttaataataatgctgataaacctggaataagttgatctaaattttgttgtagggtcgtaactttctcaacatttaaaccattagatcctaatgatgcaaactgttctaatgctgatttgatcccgtctacaccagaaggcaaactattccaatcaatatatgcgccctttgactgcgtaacagttgatacaaccggagtaaaagtaatacttacccaacgttgtactaatgatccgataatgaacatcccaagaattgaagcaccttgagtaattttacctaataatccaccagataagtcttgtgcaattgaagtaccaactttatatccaaattcctgtgtataccacaaaaatgcgatacgaatgatattccatgcaaagaaaaagattaatggaccaataatattaccacttaatgctagagaagcacctaatgctcctaaaattggtctaagagtaaaccagaagacaggatctccaaccccagctaaaggacccatcatcccaacttttacaccttggattgcagtatcattgatttctgctccattagcacgttcctcttctaacgctaatgtaacacccatgactggtgctgatacatatggatgagtattgtaaaattccatatgtctttttaaagccgctactttatcttccttatttggatataattttttgattgctgggataattgaataacaccaaccaccattttgcatacgttcatagttccaagaaccttgaaggaactgatgacgccaagcaacagacatacgatctttttttgataatttaattttttctgccataatttctttcctccttcaagattttaatagtcatttaagatatcgcctaatggatctccagaacctgttgaaccgccaccattagagccactgttttcttttaatcctaaatagatgattgctaaagcaacaccaattgctcctaatgcgatcaatgttaattcaccgattgcagcaagaacaaaacctaatgcaaagaatggccatgtttctttagtagacatcatattgattaccattgcataaccaactgccgctaccattccaccaccaacagtcattccgccagatagccatggtggcatttgatttaatgcatcagttacaactgccgcaggaacaacacaaagtgctgcagcaggaattgcaattcgaattccttgtaataagattgctaaaatttgccacatgtcgattgcacgcatatttccttgttcggctgccccatccataaagtgaacaattgggattgtaagagtacgacagatcattgttaagaataaacctgctactgataaagggattgcaactgcgattgcagtagaaatagctgtttgcacatcagttgctccaccttctaaacctaataccataataattgatgaagctacagaagctaatgctgcatctggtgctacagcagctcctacattggcccaccctaatgcaatcatttgaagcgaaccacctagaataatcccttcagttaagtgaccacttactaaaccgattaaagtacatgccactaacggttggtgaaattggaactcatccagaattccttccatccccgctagtaaggcaattataataattaagattattgtaattaaagacattataattcctccctacattttatttttaaacatttttcaattctgcttttgctttctttaaaagcgtatcaatattttcatttgaatcacttggtactttacgaacattaaaagtaattcctttagctttaattttttcaattgtttcaatatcttccggccccattgcaatagctttatttactaccactttaccaattgaatgagccattgaaccaatatttaattctttaatatctacaccgccttcgattgcccgtaatgcatcttgaggtgtttcaaataataacattgctttggtattaccaaaacgtggatctttagccacttgaatcattttatcaattggaacaacattagccttaactcctggtggcgcggcttgttcaatcatctgtttccgtaatttatcttttgaaacagcatcagaaacaacgatgattcgatttggttgtgttgttttagtccaagtagttgcaacttgaccatgcaataaacgcgtgtcaattcgtgccagaacatatttaatatgtccatcccctaatacagttccctcaggaatagctccttgtgactgtgtattaatagcttgagccgctactttcgtttctggttctaattcttcaggttttacttttaccccttctctagcaacttcagtaacatgtttagcaatttcatgcgctgtttccatcgtcattctagaagcataagtctcaatcagcattggtaaatttaaacccgtaacgattgcccacttatcttcatgaccagcaattaatccattagcctgattaaatggtgtaccaccccataaatcaactaaaaatagtacttcgtcttggttttcaaaagtagctattgccgcttccatttttgctttaagatcatcaggtccttcacttggttgcaaagtaactgcttttacatcgacttgatctccaaagatcattgccccggattgtagaatcccgttagcaaactcaccatgactagcaagaataattcctaccattataaattcctccctttcttttaaatactttataacgcaaaaaaacaggcaaactattattaaaagatacaaaaataccatctttgttctttttttaaatagttaatgcctgctttatcagttacacactataaaatattcaatttatgaaacaatattatcattgtaagccttttctgtcaagaaatcatttaaaaattattatttcaaaataatatatttttaaatacttgacaatattctttccaaatgtaatgccagatatcctacttctgtctctggtaatttcttttttaaaacctttgataatgcttcacacatgttacttgcctgttcatatgcaaaaggaaacttatctttagtaaattcacttatatccatctgcaattcttcatttttatttaatcttaaaattaaaaatttaatatgattcattaatcgagcatatgaaactgattgaatatcaataacaatattaagatcattttctaatttaataatactttcatgaataattcgtgttgcctccattgactcagcaacttgattagaagaaattgctgaatgaatatgtagtgtaataaagccaacttcatcatcattgatcattcgtgatataaacttattaattacttcccgtccttctaatgcaacctcatattcatcaggaaacagcaaacgaatatcattgataaatggatttaaaggcattatattttcatccattcgctttattgcaaaatagatatgatccgctaatggtaataagatatcattatcaatttttccaaatttctctattatcagtctaataatctctgatgctatttctaaataaactggatcaatataattgattatatcatttgaaccacttttagctttatatcccttttgcataagaaattttttagcattccgtggtacttcaaaataatcatccactttctttgaaaatccaattcctttatacataataataacttcttcagtctcattacaagctaaaatagtattattatttaatactttaatgatcttatacatatttattttccctctcctagttgcaaatcttcataattgtactcccgctctttattttaccatattctttttcaatctttaaatcatttgatagatttgtaaatattaacaaaatactttcatctaaagcattttctttaatatactctaaatctgcattccaaattaaatcacctttttgcactctttgatttaatttaactaatatttcaaaaccagttccatttaaattaactgtatcagttccaaaatgaatcaacaattcatatccgttatctaatttcattccaattgcatgttttgttggatagatcattgttatctcaccatcacaaggggcaacgatcaaaccgtgaaatggcttgatcataaccccatcacctaacagcttatgtgaaaaaatttgatctggagcctgttcaattggcaaaacctcaccatcaacaatattgcctaattcaagattagtatgatcagtctctttttccagttgataatcatctaattcatcaggaatatttattaaatactcgtccagctttgatttgatcgatgatgctttaggaccataaattatctgaactccatttccttgcataacaactgccgctgcccctgattgtttcaataaaccttcatttactaattgattatcactaactgttgctcgtaatctggtaatacaacaatctaagtcagtaaaattatcacgaccacctagccctcgaacaatcaattgtgactgtttgtcaatttcaattcctttatttaacaattttcgatgacttgctttagggttcttaaagatagataacttcatattatctatctctctacctggagtcttcaaatcaaattttttaattagatatttaaaactaaaataatagagcatgaaataaattattccaatagggataagcaatacccagctagtcttactattaccttgcaatacaccaaaaacaataaagtcaaataaacctccagaaaaggtcaatcccacggcaatattaaaaatatgagcaaccatataagcacttcctgctaagataacttgtaccccaaataacagtggagcagcaaacaaaaaagtaaattcgattggttccgttattcccgttaagatgcttgttaaagccgctgagaacaacaaacttccaatcgcttttttattttccggcttagcagtctgatacattgccaatgctgctcccggtaaaccaaaaatcataaaaataaattcaccagtaaaatattttgtagcctcgctactaaaatgcacaatatttggatcagctaactgtgcgaagaaaatattctgaccaccataaattaccgccccattgacgaccattgaacctccaattgcagtttgccaaaatggtaaataaaatacatgatgtaagccaaaaggaaccagtaaccgtttaattacaccgtaaacaaaggttccaaaatagcctgaggttgagataagtttacctaattcatatataccattttgaaagaatggccaaacataaaacattacgattcccacaaacaaaaaagttattgttgaaattatcggaataaaccgttctccttcaaaaaaagataacgctcttggtaattcaatttgataaaagcgattatgtatataactaacgccaagaccgacgattattccaccaaatacccccatttccaatgacatgatcccacaaaccgctgtaatcgttccatctaaaacatcaggattaattatttgattatctaaaatacttccatttaatgaaagcatcccgctaattgttgtatgcataacaaaaaaagcaataattgaagataaaacggctacttctttcgcctttttcgccattcccaacgctactgcagcagcaaaaataagtggaagattgttaaaaaggccactccccactttagttaagattattaaaaagtcatgtaaaaaagtcccgtttcctaaaactccctctaaatgtagtgaagaaatagttgtttcattagtcaatgaactaccaattcccagaaataaacccgcaattggcaatactgcaatcggcagcataaaactgcgaccaatcctttgtaaaatcccaaaaactctagtcttcataatccctccgttattccaacataatttattataactaaatcgttcgatcaaaaattctttttataattaagaccatgatacttataataatcatgataaagactatctgtcaacaagaataattacttatttatacgatatttactactttttttgtcaatttaaagagaaataattaaaaaaatagaattctattttaatatgctccgcttaagtaaacaaggaacatatcattttgaattctatttctttaattaaatcagtttctaacatatgcttttaatacttttatttcatttttatcaaacggttcaatagtaaactcacctacttgagctggtacaataaaagtttccgcataatgcactgtatatggctcaaacttatttttaggacttttaattactgcactttccccagcaactaaattcatcattaccacacttttattagtttgttgataaatcttttgtttagttgtaataactcgtgtttcaataaattctaattcatgtaatccggttttaacttctgtatattcatcactcttttcaatttctgtaaaattatttaccaaattggattctacccaagtagttgttctttgataatcaattaccttctttccatcttcaacatgaatcgggcgtggtttaccatctaatcctacacgatcccaatcccataatttaaaagtaaaaatatatggtgtagcacttacttccaagactacacaattagccgaagaacaatgaattgttcctgctggaattaagaaatgatcatgcttttttgctggaaaaaaattaatatacttatcggcatcaaaactttgattaccctcattagctctttctaaatcgttaataaattcgtctgaattaatattctcttttaaacctaaatatactccacctccatcacaatcaaggatatagtagctttcatcttgcgtataaggcattccaaaatggctcttgatatattcagttgttgggtgtacttgtaagcttaaatttcctccacccattgtatcaagaagatcaaatctaattggaaactctgccccaaaacgagcataattttttgctcctaaaagctctatagcttgatacataacaacatttaaagctggggttgcaataacaatatcgccaaacttcaaattaatactattctcctctggaaccccatcaaaactccaagcataattagatttacttttatctaaattacaaacctctttcatccattgtcctccccaaacccctggatcaaaatatggtactagacgaaatggttgattgcaaacactttttaatgcatttcgaaacgcaataccagtaatcattttaggtttattactgcaattagtgtctagatataaatcaatatcttcaaaaatctctcgtttatgcttatcggcaattcgccactcaataaaataaccacgcttattttttattagaggatcttcatcataattactttgtttaaaattaggtaatccagcccgatatcttaattgaatttcccatcgtgttaggtctgcatatattaataaatcacctttagtaattagacttgccccaaaaccgtatacaagaactattccttctttatttttaacaaacttttgtatcttagccagcttagcttcatcaacataatctctaatagttccataatacattactcccctgacacgatctttagttagattcacctgcatcatttctgtcaattttttaccatcataaaagatatcttcacttaaaattacgtgtgctggagtcaatttttttatcaatacatttaataattcacgatcattaattcccaaataacaatctacaacaactatctttttatttcctaaagattctttaattttcttatcaatctgcgcatatccagaatatgcatcgttgtcatagccatttattttgatataggggctattatcataattactcatttgctttttgcctcctactcaatcttatttatactcaggttctgtatcttcagcttcaaaacatcgtgttctcattaattcttttacccaatcgcctgattttttaattctccgattccgattattttccatatcaatttccacaaacccataacgatttctaaatgcattaacaggtgaaagattatctgtaaacgtccaattcaaatagccccgacaatcacaaccttcgtcaattgcttttaacatccaagccatatggtcacttaaaaattcaattcgatagctgtcctgaatttgcccgctagcatccttaaacttatcttcacccattactcccataccattttcagtaatccaacattcaatatttcgataatcattttgaatgatcttcagcatattataaattcctttaggataaatttcccatcctcttgaaaaattcattttaattcctcgtggactatatgtttcataatatgcagttggaataaatggtttatctggattccatgccgtttctctttgtcgaacccgtaacggctgataatagttgattccaacaacttctattttattatcatcaatcttttcaaaatcacctttaacatattcaaacatacactcatgtttttttaataattcaaaatatgcttcatcaaactttccatttatcaaagggtcagtatattgtttaaattaaaaaaaaggcagctcagtgctattcactttaactacctaatttagattacgcttttatcgccggtttaccatattttttacaatatatatatcctgcaattccaacgattacaaaaacaatggaaactaattgtgccgtccgtagacccattacatataagctatcagtacgaagtccttcaataaagaatctaaagattccataccaaataaaataactaaagaattgtacaccttgttttgtttggatcttcctaatcacaaaatagattaataaaaatcctacgatattagcaatagactcatataaaaaggttggatgatagtaatatccattgatatgcattccttcaataataaagtttggtaaatgcaatgatttaaggaaatctagactaaccattccaccatatgcttcctggttgaaaaagtttccccaccgtcccagtgcctgagcaattaaaacacctggcataattgcatcagctgcaaccatgaaatcaattttatgtttcttaaaataccaccagctaaaaatcaagccaacaaaaatcccaccttgaatcgctaaaccaccatgacgaaacataatgatctcaagtggattttcagcatataattcgttccacataaagattacataccataatcgagctcctaaaactccagtaatcattaaaccaaagaaatagtctgaaagaatctctttattataaccgatttttttgaaattatattgtcctagtttatatgcaataaaagctccggtaataatacaaattgcataccaagcaatggaaaaagaaccgatttgaacgaatgtcttaccatctggaaaaaaagtcataacttaccccttattcttatcgatattcttcaaaatacgatcaacgaattctttgctagaatcaacaccgtattcacgtaaacgcatattcattacggcagcttcgataattactgacatactacgtccacttgatacaggtacaacaattttaggaatcttaacacctaagatttcttcagttgaatcattttcttcaacccctactcgtgtatattcacgagatggtacccaacgatctaattgaataattaaatcaactttatctttatcgagaattgagctaattccaaacatctttgatacatcaataacaccaattccacgaatttctaataaattagttaatacttctggggctttccccacaatactttgtcctaaatgatataattcaacagcatcatcagcaactaataaatgtcctctttttactaattctagagcaatctcagatttaccgataccactatcacctttgataataacacctttaccgtaaatattcaaaaagactccatgaatcagtgtttccggtgccagtgcttcgtcaagaatatttgttaattcaattgaaacacgtcctgttgctgattcggtaataaaaattggaaaatctttttttcgagcaatctcaattaagattgctggacattcatttcctttagcaacaatgatacatggtacttcatcgttaattaagaaagggaatatttcacgttgtctttcttccgacatctcattaataaatgcagactctttatctccaaaaattataattcgtcgaaaatcgctgtgtttaaaaaatcctgctaattcaaatccaggtcgattgatctcagccacataaattggccgctctaaagatttctcatctccagttacctgaacataatgctcattgtttaataattcacctactgtaattgactttggcatcattgtttcctccctataacatcttctttaaaaaacttccagtataacttgcttcacatttagcgactttttctggtgttccagctacaacgatcgtaccaccaccatcgccaccttcaggacctaaatcaacaatataatcagctaccttaataacgtcaagattatgttcaattataatgactgtatccccttgatcaacaattctttgtaatacctctattaatttagcaacatcattgctatgtagaccagttgttggttcatctaaaatataaactgttttcccagttgcttttttttgtaattcacttgctagcttaacccgctgagcttccccaccagataaagttgttgcactttgaccaagcttaatatagcctagtccaacatcatttaaagtctgtaatttagttttgatctttggcaagtttccaaagaactccactgcatcttcaatagtcatctctaaaacatcataaatattcttatctttataagtaacttgcaatgtttcttcattatagcgtttaccgccacattgttcacaaggaacataaacatctggtaaaaagtgcattgaaatacgttttaacccatcaccttgacaagcttcacaccgtccacctttaacattgaaactaaaacgtcctttatcgtagccacgcattttagcctcatttgtttgggcaaataaatcacggatatcatcaaacactcctgtataagttaccggattggaacgtggtgttctcccaattggatcttggctcacctcaataactttatcaatattttctaatcctaaaatatccttatgtttaccgggcttttctttcgagcgataaattcttgccatcattgctttacccatgatttcatttacaagagtacttttaccactaccagaaacccctgtaaccacagacatacaccctaacggaaacttaacattgatattctttaagttatttgcagcagcaccttttacttgaataaaattaccatttcctttacggcgttttttaggcacatcaatctttaaacgacctgataaatactgccccgtaattgactttttacaatccattacttcttgtggcgttccagctacaattacttcaccaccatgcactcctgcacccggtccaatatcaacaataaaatcacttgctcgcatcgtgtcttcatcatgttcaacaactagaacactattacctaaatcacgaatattttgtaaagtggcaattaacttatcattatcccgctgatggagtccaatagagggttcatctagaacatataaaaccccagttaatcttgaaccaatttgtgtcgctaaacgaattctttgtgcttctccaccagataatccacccgctttacgagataatgttaaatatcctaatccaacatcatttaagaaacctaaacggtctttaatttcttttaaaacaagattagcaatcttcgcttcatattcatttaattttaattcatcaacgaattttaaagctttttcaattgacatatcggtaaattcactgatatttaagccacctactcgtacgcttaaaacctgatcatttaatctgcgtcctccacaagttggacacgtatgttcagccataaatgaagcataccattcttttgaccaagaagaagtcgtttcttcaaaacgacgtttaatcaatgttttaacaccttcaataggacgattagttttagaaacattaccactactagaaacaatctcataagaaattggtttatctgagccttctaagataattcttaattcttttttagtaaagtctttcaatggtttatctaaatcaatcttatatgttttacataggatcaaaaagcgctgccattcaattcggtcagttcctactgaagttttaaaatatctaattccaccttgatttatgctcaaatcccaattaggaatcaataaatcatcatcaacttcattttttattcccaaaccgcgacaatcaggacaagctcctagtggattattaaatgagaataatcttggttctagtttaggaacactaaaaccacactctggacaagctaaatgctcagaaaataaagcttcactgccatcacttaaattagctacaactacttctccacctgttagttttaaacctacttcaagtgaatcaatcaaacgactacgataaccttcttttttgataattcggtcaattacgacatcaatgttatgtttcttatttttatcaagttcaattccttcatctaatagtttaacttcaccatcaacttgaactcgaatataaccatctttcaataaatcctcaaataaatccttaaaagtacctttttgattctttactactcgtgctaatacttgtaatttactaccatctggatatttatcaattgtatcagccatttgtttgattgtctgcgattcaatcacgattccatgctctggacagtatgccttaccaatacgcgcataaagtaatcttaaatagtcaaaaatttcagtaaccgtccctaccgttgaacgcggattatttgatgttgttttttgatcaattgcaattgccggtgacaaaccttcaatactatcaacatccggtttttccatgtttcctaagaactggcgtgcataagcacttaacgattccacataacgccgctgtccttcggcatagattgtatcaaatgccagcgatgtttttcctgaaccagataatcccgtcataataactaatttattttttggaatctcgatatcaatattttttaagttattctctctagcccctttaatgactagtttatcatgttccatattttacctaccttctaccatctttaagattgctgctttactgtgcccccgtaattgaagatcataagcccaatctaatagctcgctatacttggatgacggttcaatccctaacgcctttaaatcatatccgtcaactaatggcaactgagctttggttgatagccgtgccatcttttctttcataacataatcaaagcgattaatattttcatgttcatctttgtatctaccaagtttatcacattttgtgattaaaattaagtcttcaatcgtaactattccatcaattcctttaagaattttaaaatagctataatcctttgcttcatttctgaccatattcattaaatgcatatgatagaaaatcattgttttaatatatttttgtaactgtttatctgggataaatgcttttacttcttgattaaaaatctttacccccgcttcattatgacccggagcatgaccgtctttagttgttactgtagctttaccaatatcatgtaataaagcactccacataaaacctaatggattacttgttttatggcagcataaagccgctaaatcagttactaataaagtatgccgccatacatctccttcagggtggtaatcaagccgttgcatagttttcgataatacatctaaacatggccacaaagccttgatctcctttaaaaaagttaacccaattgaaggctgctggcttaagaggagcttactatattcttgaaatacccgctctttacttagtttatccaaacttttattttgaaccatttttttacacattaatttagtcgccgtctcaatacagaaatcaagacgtgaagcaaattgtgctgttctcaagactcttaacggatcttcaataaaagttgtttcactaaccattcgtaatgttcttttttcaatatcttcttgaccatgaaaaaaatcatagatttttcctgtctttatttcatacatcaacgcattgattgttagatcacgtcgtgatgccgcaacttttaaatctaaattttgatttactgtaacatcaaaatcctgatgactctcacctgtctttatttccgttctcggcaaagcaaaatcaaaatttggtaaaacatctaattttaaaattccgaatgatttaccaatactattgacattgccataattagctaataattcttccaattcatcgacactaagcccatatacctcaacatctacatcatgataatcaaccctattgtagatcaacatatcccgaacgattcctccaactagaaaagctctaccatggtgctcgtctatatccttaaagatctttttagcaagtggactgaaagtatacctatttttcaccttgaagctccatgatgatatcgcgaagttccatcgcacgttcaaagtcaagtaccttcgctgcatctttcatttgtttttctaattcttgaatcataacttgtttatctttcttgcttgctttcttaccttttttaactagacttgcagcatcatcgatgacctcttgaccacgaattgcatcacgaatttccttatgaatagttgttggggtaatattatgttctttattataagcatcttggatcttacgacgacgattagtttcttcaatcgcataagccattgaatcagtaatcttatcaccatacatgattacttcaccattactgttacgggcagcccgaccaatcgtttgaatcaatgaacggttacttcttaagaacccttctttatcagcatcaagaatacatactaaacttacttctggtaaatctaaaccttctcgtaataaattaattccgactaaaacatcatacttgccaagtcgtagatcccttagtatctcggttcgttccaaagtctttgtgtcactatgtagataagctaccttgattccaagttctttcaaataagcacttaaatcctcagccattcgtttagtcaatgttgttattagaactctctcattacgatcttgacgaattttgatttcactgataatatcatcaatttgatcctttgttggtcgtacttcaataaccggatcaagtagtccagttggcctaataatttgttcaactactttattttcaacatgttctaactcataatccccaggtgttgctgatacataaatgacttgatttataattttttcaaactcttcgaagcgtaatgggcggttatcaagcgcgcttggtaatctaaaaccatattcaactaatgtctctttacgtgaacgatccccattatacattcctcgaacctgaggcaacataacgtgactttcatcgacgatcattaaaaaatctttaggaaaataatcaatcaacgtataagggcgttgtccttcatcacgaccatcaatatgccgtgaatagttttcaattccaggacacatccccacttcccgcagcatctcaacatcatggcgcgttcgttgttccaaacgttcatgttctagtaatttagtttctgctttgaatgtttctaaacgattctctaattctgccgtaatcgtatcacaagcctttaaaatttgttcttttttcgttacatatccataagctggatagatcgtatatgtattgtatacgcccaagacatgcccagtcagaggatccacttcactgattctttcaactgtatcaccaaataattcaattctaattaaccagctttcagtatgtcctggaactatttcaatgacatccccacgaactctaaatgttcctttagtctgttcaatatcattgcgttgatattgccgatcaactaaatatgttagtaactctttacgatcaatgtcttgatcgacccgcagtgaaaagatcatttctttgtactgttcaggatttcctaatccataaattgaagcaactgaagcaacaacaatgacatcttcccgttctattaacgaattcattgccgcactgcgcagcatctcaatttcatagtttgttttagcatttttatcaatatataaatctcgcccaggaatataagcttccggttgatagaaatcgaagtttgaaataaaatattcaactctattttcaggaaaaaattcttttaattccgaatataattgtcctgccaatgttttattgtgagccaagacaagtgtcggtttattcacagcagcaataacattagaaacagtgaaggttttcccagtaccggtccctcccagtaagacctgttctttttttccttctttaattcctgcaactaattgtttaattgcttcctcttgatctcccattggagaaaacggagaaacaagcttaaatttttgcattgtaacacctcctataagtcctttctattataccaagaaaacagcgaagttaaaagaattatgcccatgatgaaaataactatgccaggcatagttattttatcaattccattaattttttatactgataatcattattttcactattagcatacatgattaccgcagcctctaatttctgccgatcactattagtataaataccatcaacagttaaattattagcttgttcaaattgttttaaggcttccactgactgttgtgaaaaatatccatcattacgtccacagtcataacctaaaatacttaacattttttgcattgaggcaattgctgtaccaacactatcatatcccatatcagtttccagtgctttggtataaataccacttgtatccgtattacttacagaataatcaggtgtcaatccttttccatttatccatgtaccacttggtaataaccattttgcataagtatattttaagactgatccatcactgagctgtttttgcgtctgcgccgttcccttaccataagtttgatccccaactaatttataattcattttttcttgtaatgctcctgcaacaacttctgatgctgatgcagtatttccatttacaagaatatatccatttataaaattatatttttgacaatctttagccttatatttctcgattgcaccgtttttagtttccatttgaaaaagcagtttatcttctttcataaataaacttaatacatcagtggcagctgtaagatatcctccgccattatctcgcagatctaagaccaaagtatcaattttttcagcagtaaaagtctgtaaagctgcttcaatatcatcagctgtagtacttccaaaagtattaatttttacataaccaaattttttaccatcattatctcttatttcactagttaccgcactatctacattggctcgctctacttcaacttcttgttgttcagtattacgtataattgtcaacttaactttagtattcgcttcaccacgaattaaatcagaaatttcatcagcactcttaccagcaacactattcccgtcaacgcctgtaataatatctccaacttgtaaaccacttttttctgctggcgaatttttatacacctgcattaccattgtaccttcactaacagttcgctgtgctacaccaataccttcatagttcccatcaacactttggttatatgtcttagattcttcatatgtaaaatatgaagaatgcatatcccccagcgattctactaaagcggtaatagtattccctttgatgtcaacatccttatcattaggatttaaccaagcttcatctaatatttcataagcttcatcaataattgattctgcatttttgctagtactgttagtcggaactgttttttttgctacataaccagatacaaaaccaactgccaaacaaacaatcatacaaacaatgaatagggtttctctaatatgttttgttttctttggcttcaactttggctccggattatgatttgggcgaataaagtcttccatgtctacacctcacattactacattttagcataaaaaattaataacttttagtaaaacttaaaaaacattataaaatattatgtgacaaattttaatcatcccctgctgctcaacaatattattagcactatcaagcacggaattattgtataggaaaagcaaaatatctagttcactgcaaatgatttgatactgtttaattacattttgatataaataatcataagttttttacatcctttagaattcttaataactttatcatacattctccaattagttctattttaaactatattttattactatattaaaaaaatattatacaaaaaagctgaaagtttcggaactttcctaatactttcaactctagtttttaaaatattcatttattcctaaaacaattcccgtaacaattttatcttgataagtactgtctcctaataacctatcctcatctggattagacataaatcccatttctactattgttacaggtacttgacaccagtttattccactcatcacatcagtaataataacgccacgatttttgctgcctgtttgattacaaatactatttacaaccgtttttgacaatcgttgagaagctgtagcaatttgactacaatatggattagattccgatggtgccatagttaaagttccatgaatactactactgtcatcactattacagtgcagtcgaataaatgctccagcattatttttattagcaatctccgcacgctgctgattagaaatattcacatcttgacttgtccgaaccataattacttgataacccgaatcttctaattttttttgtaactttaatgcaacttcaagattaattgctgattctaaattacctgtacttattcccgttgctcctgttgttactttagcttttgtttgactagctccaggtccaattggctctttgttgctatcgccacgtcgttgatgtcctgcgtcaatcacaattacacgactatcaccaacgattggtaattgaactgttcgcaaagattccggaacaagtacttcgccttctttttcaacaaatgccgtttgttgagcttcaactgcttcagttttgattaattcagaatcattattttgtttacagccactaaaacataacataattaggaaaatactgagtaatttcttcattatttcacccactcttcctcattatatcatagattagctattaataattgcctctaattcaccatcaatcatctcttttaaagtttcacagctacgatcaaatttatgttgatctacattatttaaatgcagtgtcatgatcttactaatcccttgacgattaatgattgcaggtaccccgatatatagcccttcttgcttatattcaccttgttgatatgcagaaactgttaatacggcattttcatcacttaaaattgctgtaattaaacgatttaaagatagacctataccataataagttgcatttttacgtttaattatctcatatgcagcttgttgtacttctttataaattttatgcatctcgttcatatcgatattcatttccacaatatattccatcatactcttgcagccaatataagtattcatccatggtacaaatgaagaatcaccatgttcacctaatatatacgcatgaatatttgttgaggaaatattcaaatattcacttaataaataacgtaatctagctgtatctaaaatagtcccactaccaattacacggcttgttggtaatcctgatactttttggactacataactcatcaaatcaacaggattacttgcaacgataataattccatcaaatccactagccataatttgctcagtaatagatttcataatttttgcattaacactagctaattccaatcttgtttgatttggtttttgagcagctccagcagtaattacaacaatatcagcatctttacattcatcataaccaccagctttaacctttaaactacttttactatatggtagaccgtggctaatatccattgcctctccaattgctttttcttgatccacatctattaatacaagttcatcaataccaccagtatttaaaatagaatatgccattgacattcctacaaaaccagtccctactaatacaacctttttcaaatcatcatcttgtctcattgttagttcctccttacaaaaccataatagtatttattactaaaattgtcatttgatatgctctattaatttattgtactcatttattataaaattaaaccaggataacaattctttagtcataaaatttcttacaaattaataagtggtaacgaatctttctaaatccatgatagtataataaaaggttatagtattatttaataacatactataaccactatcttttaaataaattctttttcaactataaataatttattttgtaaccaaaaagggttcttactaattaagaacctcttaatctatagcattactaatgaggctatataaccaaccactaaagcaataacatacgaaataaataatattttaaatgtgtcttttttattctcattatattttattaaagctaatgttcctacaccggcacttgtcgttaaacctgtcagtaatgcaccaaaacttaaaccaccggacacatataattgtgtcagtataactgaaccagcacaattagggataaaaccaataactcccgcaatgattggctggaagatccaatttgtttttaaaaggttggttactgtttcttcaccaatccccgcaataattaatgtaaagacgatatttgttaataaaataaagataaaaatattgagtgtatgtcgtaaagccggtaaccaaataccattttgacaaccacaatcacaaggctctacttgtaaatattcataatcatcatgacttcgatgattcaaacgatctactacataaccggtaactgtacctaaaacaatttttaaaacaattaaaacaactaacatttcccataaatcaggatgtactactaaaatagccaaagcttcatcacttgtggcaataaagattgataataaagttcccattgtcaagtaacgcatcgaatataatcgggccgcaataactgaaaaaccacactgagggatacttcctaaaatcgctccgataaaaggaccgacttttccaaactccattaccttattgacaacatcacgattagatatgtattctactaataagcaggccaaaaataatactggtactgtcatcagggattcttgaattggttctaataatatttccattaaatcactcctatctcaattgttagactagcataacttttatatagactttgtttagtttaccatattcttatataatttcaaacttatttctctattatacgctcaattatacaaaaataaagcgctgtttttgtcttaacataatatttataatccttatcttgatgatttaagaaatattagctaaaatggaatcattaaataacaaagggatcgagaataatgaaaataacaaaaaagcagttaaataaaataaaaatgattgtttgtgatcttgatggcacactgtttaaccataaaaaagaaatatcatcagctacaatcacttatttaattaaattacaagaaaatggttatactcttgttcttgcaacaggtcgcttcttttatgaattaaagccatacattgaacaattacagctggaaaaatatcatggctatgtgatttgctgtaatggaatagagatttatgatcttactcacaataagtgtagatctttttcttttttagaacaaatagaaattaacgaactacttcaattagccctttattaccggttaaatatacgtgctaattttgatcataaatatcaaatgattttaaataattggctatactttttaatccccttgattcgaatatttactaaacgttatcccgacctcactttttataaaaatactgctgtagtaccttggaataaacttggaaaaatttgtttactttcttcacctagaaaattaaagctttttgaagctgctgcacaaacaaaatttcctggactatatcaatattattacaccaacccttactgtgttgaagttgttaaagcagaagtcaataaatgttatgctgtaaaatatttatgtcagttaaataatttaaatttagaaaatgtcttagcttttggagatagtggtaatgatgaagaattattaaacaatgccggtattgggattattatgaaaaatggtctttcctcattaaagaaaaaagctacctatcttactttcaaaaataatcgacatgagggtgtcttaaatatgttagaatatttatttgatgatcttattaaagataaaaattaggctaacagcctaattttttatgacaaccgatttttaaaatcacaataattgaattctttgattattttaagtttttctttttgttttaaaacaatactaggtaagttcatcccattaaaagtattattttttaccattgaataaattgccatatctttaaaccataactgttgtcctacctgtaaaggctggtcaaatgaataatcaccaataatatctccagctaaacaagttggtcctcctaagcgatatgtgtatgttttaacatttggtagtgcactatcgataatttctggtcgatacggcatctctaatacatctggcatatgacaagctgctgaagtatccataattgcgatagccataccattgtgggtaatatctagaacactggaaactagaaaaccagcatttaaagccacagcttcacctggctctaaatatacttgtacttgatatttttcttttatttcattaataatttttattaatttttcaagatcatagtctttacgagtaatatgatgaccaccaccaaaattcaaccatttcatttgtcctaaatacttaccaaatttttcttcaacagccctaatagtagttattaaatcatcgctgttttgttcacatagagtatgaaaatgcagtccctctattccctcaagcagttcttccttaaagttttctaatgttacccccattcgtgaaaactttgcgcaaggatcatagatttcatgacctatttgagttgaacattcaggattgattctaattccacatgaagtacttgtttgttttgctagattttgatatttttgccactgattaaatgaattaaagactacatggtcacatatattcatgatttcttcaatttcatcatcacgataggcggtactaaaaacatgattttctttatgcatctcttcatagccaagcttagcttcatatagtccactagcagttgtcccatctaaatattcagctattagagggtaaacactgaacattgaaaaacatttttgagccaatagaattttacaaccagttcgttctttaaccgtatgaagtatttttaaatttttttctaataattgttcatcaattaaataatatggtgtcttcattaatctactaataccggattatgatcttcaatccatggcaatccccatttatttaatgcttccataaatgggtccgggtcaaattcttcaacattataaacaccggctctcttccattgaccttgtaataacagcatcgttccaatcattgccggaactcctgtagtataactaacggcttgagacccaacttccttataacattcttgatggtcgcatacattatataaataatattttttttcttgaccgtcttttttcccttgataaatgcatccaatatttgttttgccaactgttcgtggtcctaagctggcaggatctggtagaactgcttttaaaaattgcaatggaataatctgtttaccttcatattcaattggttcaatcgatgtcattcctacattttctaagcactttagatgtgttaaatagctttcgccaaaagtcataaagaatctaattcgtttgattcccggaatatttaaacccaatgactccagttcttcgtgatgcaacaaatacatatcttttttaccaacttgggcaaaatcatattcacgtttaatttccattggttttgtctctacccaatgtccatcttcccaataacttccgttggcagatacttcgcgaatattaatttctggattaaaatttgttgcaaatggatatccatgatccccaccattacagtctaaaatatcaatataattaatttcatcaaattcatgctttaaagcgtaagcactaaatacacctgttaccccaggatcaaaaccacatccaagaatcgctgttaatcccgcctgttcaaatttttcacggtatgcccattgccagctatactcaaattttgctgtatcttccggctcatagttagcggtgtctacataatgacaaccagcttccaaacaagcatccataatttttaaatcttggtatggtaatgcaagattcaaaactacctctggttggaaatctttcattaaagcaactagctcttcaacattatcagcatcaacttgtgctgtatgaataattgtttttgttttcccatctaactgcgcttttagtttatcacatttactttttgttcttgacgcaatcataatttcttcaaatatctcactgttttgacaacatttgtgaatcgctactgttgcaactccaccacaaccaataattaacgttcttttcatttattttctcctttattcattgctaataataattcccttaatactttgcaagcgactgccgttgatcctccactttgatcataaacaggtgataattcattaatatccatagctactacatttagctcacttacagcaatcatcgcctctaatagttccataaaagtcacgcctcctgcttcgggcgttcctgttcctggaaatacactgggatccaagacatctagatcaattgtaaaatacaccggatacccgcggcatgcctcaattgcttttgatagtcctgtaaaattaaatttatttaaattagtatgttctctagcaaagtaaaactcttctcgttcaccactacgaattccaaattgatatattttattatcaccaattaaatcatatattcgtctaatcacagaagcatgggaaagtttttcacctaaatactcatcacgtagatcggtatgagcatcgaaatgaataacacgtatctctggatatttctcaaatactgcctcaaaagctcctaacgtaacaagatgttcgccaccaatcatacatggtaatttatttgctttaataattgtttttgttgttactttgattatatctaatgctttgcggggatttccaaatggtaattcaagatcaccaccatcaaaaactttaatatcttctaaatctttatcctgatagggactgtatgtctctagaccaaatgactcttggcgcattgaagatgaagcaaaacgagttcccggtcgatatgaggtggtactatccattggggctccaaagattacacactcagcttcatcaaacgatgcctctagtccaataaacgtctgtatatttttattccacatctcttaataactcctctacataatttggtaatgcaaacgaacctacatgaatgccggtattataatactttgttttcatccctcgagcattccattttgttttttgaaaatctttgatgggatgatatttttttgaagcaaaaccaaataaccaatgccctgaaggataggtaggaatatgcgcttgatagactcgagaaatcggaaaactttcaacaattcgtttatgagcccgttgcattgcaacagcatcttcttgataaaaaggactttcatgttgattaaccataattcctgtatcatttaatgctttataacagttaccataaaattcctttgtaaacagtccctcacccggtccaaaaggatctgttgaatcaacaatgatcaaatcatattcattttctttacctctaacaaactttaacccatcttgataatagatttgtaatcgcggatcatcaaaacaacatgctgtcatcggtaaatattttttacttacttcaacaactaactcatctatttcaaccatatcaatcttttcaatcgtttcataacggcataattctctaattacacccccgtctcctgctccaattactaatacttttttgacttcaggatgaacagccataggaacatgaacaatcatttcatgataaatgaactcatctttttccgttagcatcatataaccgtctagcgctaaaaatcgtccaaattcttttgagtcaaaaatatcaattttctggaattcactttgaccactaaataactgacaatctactttaatcgaaaaattcacaccatttgtatgtctctccgtaaaccataattccatttatttcatctcccctttaaaacattaagtttatttattgccatatcttcaggaccagtcataaagcaccctttttctttagcatattgaatataatctagaatttctttcgtgatcctttcacccggtgctaaaattggaattcccggaggataacacataacaaattcactgcagactcgatcaatactttgataaagcggcaacgattctttttctccataaaaagctgcttgaggagaaataactacttcaggattaatatattcatgatcaaacattcctgtccgatccttcttaaaccgccggcgtatttccaaaagtgctccgattaaacgctcaatatttgcttcactatcaccgaccgagatataagcaagaatatttccaatatcaccaaattcaatttgaatcccatactcatctcttaataaatcatatacttcgattccagccaatccgatatcaagtgtaaatattgataatttcgttacatcaaaatcataaacactatccccattgatcaattccttacaataagcataataatcaccaatttgattgatttctgtgcgtgcgtatcccgcaaggcgacgaaccctgttaaaaatctcattaccatgtatagctaaatttttacgtgacatatctagactcgccatcaataaatacgaaccgcttgttgtttgtgtcaaattaacaacctgacgtacataatcagcatttacattttctcctaacagtaagaaagagctttgcgtcaagcttccacctgatttatgcatactgacactcgccatgtctgctccagcctccatcgctgacatcggtaaatcatcattgaaataaaagtgtgttccatgtgcttcatctaccaaagcaagcatattatgcttatgtgccaatgcaacaatcgcttttaaatttgaacatatcccataatacgtaggattatttactaagattgcttttgcatcgggattatctttgattacttgctctacttgatcaagtgacatacctagagatattcctaatcgtttatcaacatcaggatttacataaatcggaaccgccccagtcaagatcatcgcattaatggcactacgatggacattacgtggcataataattttttctcctgctttaacacttgccataatcatactttgaactgctgaagtcgttccgcctaccataaaaaaagcatgagcggcactaaaagcatcagctgctaattcttctgcttctttgattaccgaaactggatgacataaattatccaatggcttcattgaattaacatcgatactcatacacttttcacctaaaaaatctgtcaattctggatttcctttaccatgtttatggccaggaacatcaaagggaactaaacgttctcttttcatttgctgtaaagcttcataaataggcattctactttgatctaatttcatattgcctcctaaaaaatattacttccactgtaaatctcaatcatttcttgtcgtaaattattcgttatctcaagtcttacctttggcggcaattcatagatatctgttttaaataagtaattttgtaaatcaatttctttgattaacatcttcgtatggtacaaattagcctgatatacattaatatctgtagcatcatagttaagtaatgttttaacatcaataaactgttgaatcgaagtcattgggctatccataaaaagtttctttcctttaatatcccgagtaaaaccgcggacccgataatccattgtaatgatatcagagtcaaagctgctaattaaaaaatctaacgttgacaacggtgatatttctccacaagtagccacatcaatatctaccctaaatgtcgcaatacttgtttctggatgatattcaggatacgtatgaacagtaatatgactcttatctaaatgccctaaaataactcgatcatcaacttcttccatttttccttgacgactttctaacatctcttcttccgctaataacattgttacactggcgccttggggatcataatcttgttttgaaacatttaatacatgggctccgatcatattagctacttcataaagaatatcagtcaatcgctttgaattatactgctcatcaatgtaagcaatataatctttttgttccctctgacctttagcatagcaaacatcgtaaatattaaaacttaatgatttagttaggttattaaaaccatataattttaatttctcattcataccagtttccccttctccataaaaaaaactcaagcaggtacaatcccacttgagtatcaatacgacatattattagaacatcaaaaaatatcctatattattagcgtcagagtctatatagcaagaattacttttactactcttattgattgtttcacaagtgtgatgtgcctaagcacacggttgtatagtcaccaactcaatgctaaggaatttagcatcaacttataaaattcgaactttcgttctatcaataaggcaacaaagttgccggtccggcctttgacctagctgtccgtatggctttaactcctaagagtggtcaaaagattcccgcaaaatagataactccttttgcaatatctaaattataaatcattagtttttaaaaagcaatcctaattttataaaataaaatttattgtttaatatactaaatatttttgataaaaatataattataataaatttctttaaaaagaataattaaattaataaaactaggatattcaacatatttataaaaaaatccaggctctcacctgaatcattttataaaccttttgtattatattttaaacaaaacaatataaaataaaattgttataaggacactataaagtgtcccaatcagataatattcggcaaaatcactatcttctgcaatcttattataacatgcaatcgactttgctgttaatactagttcttagaatcaattatatccccaataattactgtatacatattaatcactttcttgatattattgtaacttaatcagtttaatttatcaatcaaatataatttataattaattaaataccgtttatattaaaaagtctaacctaagtcagacttttataattataattctttaacatttattctagtaattgcctttttaagtgcaatttcagcccgcaataagtcagttttttcggttacttccttaattctttgttccgcccgacgtttagcttctttagcacggttcaaatcaatttcctctttagattcaattgaattagcaattatttttgtttcatcatcattaacatatataaatccaccaccgatggcaaatatatgacgttgtttatcaatgatataactcatctccgagatttcaatcccgcttgctaaaggcatatgatgagctaagattcctacctgtcctgctgttgtgcgaagatttaactgattaacttccacttcttggtagataccacttggtgttactatcttaagcttaaatttagtcatttgctaatgtcttcgctttttcaatagcttcttcaattgtacctacattgtggaatgcttgctctggtaaatcatcatgcttaccttccaggatttctttaaatcctttgattgtatcagcaacacggacatatttaccatccataccagtaaactgactagctactgtaaatggttgtgataagtagttacggacacgacgagcccgagctactgttaatttatcttcttcacctaactcatccattcctaaaatagcaataatatcttgtaattcttggaaccgttgtaagatttgttgaaccccatgggctacctcatagtgttcagtccctacaactaatggatcaagggctcttgatgaagaatttaatggatctacggcaggataaattcctaaagccgcaattgaacgatctaatactactttagcatcaagatgagcaaatgttgttgctggagcaggatcagttaagtcatcagcaggtacatataccgcttgaactgaagtaatagatccttttttagttgatgtaatccgttcttgtaaagcacccatttcggttgctaaagttggctgatacccagcttgtgatggtacccgtccaagtaaggcagatacttcagatccagcttgagtaaaacggaaaatattatcgatgaataataagacatcctgaccttgttcatcacggaattcttctgccatagtaagacccgttaaagcaactcttaaacgagctcctgggggttcattcatctgtccaaatactagtgttgttttagataaaacaccactttccttcatttcataatataaatcattaccttcacggctacgttcaccaactccagcaaaaactgataaaccaccatgttctgtagcaatgttattaatgaattcttgaatcaatactgttttacctactccggcaccaccgaataatccaatctttccacctttgataaatgggcagatcaaatcaactactttaattcccgtttcaagaatttcagtttctgttctttgttcggcatatgtcggtgcagatcggtgaattggcattttcttagtgctatcacctaatgcttctttaccatcgattggttgtcctaaaacgttgaacattcttcctagagtttcatttccgacaggtacagaaattggatttcccgtattaagagcatccattcctcgttttaccccatcagttggtcccattgcaacacaacgaactacatcatctccgatatgttgagcgacttcaactactagaagttcatcaccattttggatttcaatcgccgtatttaatgctggtaaattgttatcaccatcaaattggatatcaattactggccctttggcactaattattttaccaatattttgtgacatacggcacctccttattgtgcattagctcctgctacgatttcactaatttcattagtaatcgcagtttgacgagcttgattgtattttaataataattgttctgtaagttcatcggcattatcattagcattttccattgatgttcttcgtgcggcattttcacttgtagctgattcaatgatataaccataaatcactgcttgaagatacattggaatcaaactgtctaatacttcctctggacttggttcaaataatgttgatttctttgagatttcaatatgatcaaaatcacttggatcaacaggtaataacgtaacaattcttggtctaaatgttaagttattaacaaactccgtataaacaatcttaattttactaatttctttttcacgatacattttagttaattcagcaactaacttagttacatctttaaaatcaaaagttgtatttaaatcatcaaacttatgatccgttaccccttgatgattttttaataaataactagttgcctttgaaccaatactataaacataatcacctggtttgattgcacctttaatttctttaaagatattggcattatatccaccacatagtcctagacttgaagcaataacaataaatacttctttttcaatatctttattttcaactaaatagatactatcattattacccttacaattagctaagatctccgctacagtttgagcaacattagtataataaggtttcgactgttctaattgatttcttgttttacgaagtttagaagttgcgactaattccattgctttagtaatttttttagtcgattcaactgatttaattctccgcttaatttcttgcattcctccaggcatagttaactacccctttgtttgagttttttcgaattgtgttacaaaagcactcataacatctttcatgcgtttttctaaatcagcagaaattgctttttgttcattgatttcatcaataatatctctttgcgtcatattgatatgttcaactaactgatccataaaagcagacacctgttccacttctaatgtcttagtaaatccatattttaaagcaaataatgtaattacttgcgttgatacagttcgtggtgaatattgtgcttgttttaaaacctcacgcacttttgcaccatgatctaaagttgctttcgtagcagcatctaagtctgaaccaaattgagcaaatgcttgcatttcagcatactgcgctaattcaagttttagtgaacctgatacttgcttcattgctttgatttgtgcagctgaaccaacccgacttaccgaaagtccagtatcaattgctggtctaaatccagcattgaataattcttgttgtaagaaaatttgtccatctgtaattgaaattacgttagttggaatatatgctgagatatcacctgcttgtgtttcaataattggtaaggctgtgattgaacccccaccattctcttcatttaagcggcatgctctttctaataatctcgaatgtaaatagaagacatctccaggataagcttcacgccctggtggtctttttaataataatgataccgtacgataagcaacggcatgcttagatagatcatcataaacaattaaaacatctttaccttgatctaaccattcttcagcaattgcacaccctgcatacggtgcaatatattgcactggtgcaagttcactagcagatgctgacacaactgttgtatattccattgcgccacctttacgtaacttttcaacaatttgggcaacagttgaattcttttgtccaattgctacgtaaacacaataaatatcttgatctttttgatttaaaatagtatcgattgcaatcgcagtctttcctgtttgacgatctccaataatcaactcacgttgaccccgaccgattggaataattgcatcaatcgaagtaattcctgtttgtaacggttggtcaactgactttcttgtcataaccccgctggcaactctttcaattgggcgagtatgtgctgtaatgatttctccattaccatcaattgcttgtcctaaaggatttacaactcgacctaacatctcatccccaactggtatttccataatctttccagtacgtttaacttcgtctccttctttaatcgtactttcagatccaagtagtacggctccgacgcaatcttcatctaagttcattaccattccataaacatcattagggaaggcaagtaattcacctagcatggcattatctaaaccatgaattaaactaacaccatcgccaacagtcatgactgttccaacgtctttaagttcgattacatcatcaaagtgcttaatttgttctttaattaaagcactaatttcatctggtctaagccccactattttcacctactttcttaatagttcttttttcaataatgcaactttgtttttgatagagccatcaaaaacacgattatttatttcgactttaattccaccaatcagtgatggatcattaactactcttaaacgaatcgttttattttcctttttacttaaagcatcttccacttctttaacttcttgcacactgatatcatagttagtatataaaataccttctaagattccaaaatgctcattcgttaacgctttaaatgcttcaattatttccataacgtaacgcattcttctttttctaactaaaagttttagaaaattaacgacataatcattaacctgtcctttaaaactcttatctaataatgcacatttagcttcatcttctattaaaacatgactaaagaacggaacaaaacttggatcactttcaaaaacagttctaattaaatcaatatctttagaatatgcttcaacttgattcatctctttagctaaatcaaatagtgattctgcatatcttactgctactgcatccattagttaaccacttcttcaacaaagtcttcaaccaaagctttgttagtctttgtatccatttctttgttcataactttagtcgctacatcaatcgcaacctcaacaatttcttgtttcatcgctgcttttgcctgcgctttttcagcctcaatctcacgacgtgcttgatctagtttagctttatattcctgattagcttgttcttgaatcgttgcctttgtttttaaagcatcttctttagctaaattaacaatttcacgatattgaactgccgcttggcgtgcttgttcttcactttcttccatcagtgctctagctttttcattcatatctttagcttcgtttacagttccttcaataaattctgcccgtttagcaaaataattttgaacgggaacccataaatactttttaaagacaagaagtaaaactcctgttgaaagtaattgaataataattgtagttacattagggaataatttcgatgctatatctggcatacgtattcctccttagctaatattagtatacaaataataaaattaatgaaattaataaaccatagatagctgcagtttcagttaatgcaatccctagaatcattaacgttctaattttaccttccatttcaggatttctacctaaagcttctaccgccttactcgcacaaattccttctccgatacctgttcctaaaccagcacatactgcaatacctgcaccaattgcaattaaacctacatctgtcataatttaaatttcctccaatattttctatatatttttttgtaatttatatctaactaggatacctagattagagcttactcgtcgtcttcgttttccatcataattaagattgatgataaagttacgaaaactaatgtttggatacaccctgcaaaaatatcaaaataacaatggaatacaggggcaataattggacctaaaaagttaaagttgattacatggaatgaaatccatgctgtaaattgataaatcaacgtcattaaaatagatccactcaaaatatttccaaataaacgcattgaaattgaaattaatggtgataagacacttaaaatattagttgggggccacacagtatcccacacatatttaaaaaatccctttttcttcaatgcattatattgaatcaatataaaagtaataaatgtcatcgcaaaggtaatagagtagtttgaggttggtgattcaaacccaatcaaacttgataagttactgaccaatatgtaacaaaataccattgcaaaatatggataatagttcttggcaaatttcttaggcatgattgatttcatataatcatcaatagctttaactcccgtttcaacaaccaatacaattccttttggtttgacagttggatccgccaatgctactttttttccagcatagacaaagaacacgcctaaacaaaccataatgactagtgaataaattaattctacttgaattgtcactcatttcacctccttaaaatatttagcgttttatatatcctaaaatattgatcgtaatcttggtcacaaaatatccaaagaaaacactgatcaaattaaagatatcatcaaatttgattgctagcatgaaacctgcaatatacaataacatcttagctataaacatcattacaacaaatcgaatcgcctgacccatttttaagatcacatcactcattacaatgataatatagaatgataaaacgctgaccgcatatcctaagataaatcctagtggaaaactaatttgttttaggacaaatcctacgatagaaaagataactaatccgccaataaatacttttacggattgttttaaaacatctttttcgttcattctttacctgctcctaaaagtattttaataacgtagccaaaggctaaaaacaataaaattagtagaatcgtgggatgggtattaaaatacttatctaagcgcagcccaacaatcacagctaatagaaatgctccaattacctgaaaacccaattgtaggcaaaagaataaatcttttaacattttcttcttatcttgatccataatccctcttgtattctactatagtcttttggttatgtaaacttcttataaaaatttgtaataattatttaacactatgataatttatttatagaacaagtatttcagtactaaacactataattaatttcataattagacgttttaaccacttttgaagtatctcaaatattaatcagtaccaaataaacgatcaccggcatcacctaaaccaggcacaatatagcctttttcattaagtttctcatcaagcgtcgctaaaatcaattcaacatcaggatgatcttcttcaattactttaacaccttcaggggcacctactaaacagactaaacgaatatctttagcaccacgggctttaatatttgtaatcgctgcactagcactaccaccagttgctaacatcggatcaacaatgattacgatagaatcttctaaaccactaggaaatttagcataatactcttcgggaattaaagtttcctcgttccgagccattcctatatgaccaatcttagcagtcggtataattcttctaaaaccatcgactaaaccaatccccgctcttaagattggaacaagaataatttgttttttcaattcttttccaatcattggacaaattggtgtgacgatttccttatcaactaatggtaattctttagttacctcataagccattaacattgcaatttcgtctaggttatctttaaatacgattgttttcgtatctttatcacgcataatcgttaatttatgatcaattaatgcatgattgaggatggtcgttgccatataaattcactccttaaatgtattttatatcatgatacatttctactttatcagttaatgctctaactctctttaagcattcttctttgatttcatcagtttcttcattttttaagcgataagcaataatcttacctacttctctaaaatcttcttctgtaaatcctttagtagtcattgcaggggtcccaacccgaataccacttgctttaaatggtttttctgtatcaaatgggatagcatttttatttgcagtaatattaatttcatctaataaacgttctgcttttttacctgaaataccgcaacttgcttttacatcaattaaaatcagatgattatcagttccgtcagcaactaatctgaatccctcttcttttaatgctgtttctaatgctttagcatttttaattacttgagctgcatattctttaaattctggttgcattgcttcataaaaacaagcggctttagcagcaataatatgcatcaatggaccaccttgcattcctgggaacaccgcacgatcaatatcagctgcatatttttctttacacataattaccccaccacgaggtccacgtaaagttttgtgagtcgttgttgttacaatatcagcatgaggaaatggtgatggatgcagtcccgctgccactaaccctgcgatatgtgccatatcaaccataaacatcgccccaacttcatgcgcgcattttgccatgtattcaaaatcaatcgttctagaatatgcactagcaccagctactactaattttggtttgacctcttggcattttttcttaaaatcttcataatcaatagtttcagtttctttagttaccccgtaactgtggaattcataattgattcctgaataatttaatggatgtccatgtgttaaatgtccaccatcagcaagagacattcctaataccttatcaccatgatttaataacgccatatataccgctgtgtttgcttgcgctccactatgaggctgaacattagcatactcagcaccataaatcttacatagtctttctttagctagtgtttccacttcatcaacaaatttacatccaccataatatctttttcctggataaccttctgcatatttattagttaatacagttcctgccaattctaagatttctggtgaaacaaagttttcagaagcaattaactcaatattgtttctttgacgatttaattctctctctacactttcaaatactgcgatgtctttcattttactcttccccctcgtaagccatcatttttgcaatccgctggtcatgtcgaccaccttcatatttgccttctaaccaggctgttaaaatttctaaagctaaaccttcaccaataactcgttgccccatagcaatcatgttagtatcattatgtgctcgagttgctttggcgctaaatacatcgtggcataacgcacagcgaattcctttcactttattagcagtaatacttacaccgataccagttccacatacgacaacccctctatcgcacgatccactagcaaccgctttagctgcttttcctgcataatcaggataatcacaactatcttcgctgtatgttccgaaatcttctactatgtaaccattagcttctaaataatcttttaaaacattttttagtcttaagccaccatggtcacaagccattgcaattttcattcaattacctccgctatttgttccttagaaatatcacctaatcttaatatttccactttacccttacttaagtcaacaattgtacttgccttcttactgatgctttcacctttaacaattaaaggaatctttccatgaaatactttcattactgctttgtcgtcaacaagactattttctccagaaagattggcgctagttactaacattggtcctgttttatctaataatgataaaacaaatggatcatctggtatcctgattccaatagtatctagtgaagccgtaaaataatcatcaatatgtgggcgtttctttaaaatgatagtgatcattcccggcataaaagccgcaataagtttttttgcagtttcatcaacataagcatatttttcaatatcctctgccttactaatcatcatagaaattgcttttcctttatcgcggtgctttaattcatatagtgcatccaatgcctgatgtgagccaaacttaactcctaacccaaaaacagtctcagttggaaaagccacaactcgactatcgctaactaacttagcgacttcttcaatggcatttttttcgactgaaactgtattcatggaatcacctcatttgccccattatacaataaataattgaaaatttgtagatatttcgtagatattttcacgacaaaaaaagttttttaaaaaaaacatctttacattatcttaacattgctaatttccttcatttttatagtttgataagacaatttcttacaaaaaaacaattagatctaatctaactgccatttacattttttcatatcaacattgccattatctttaaaacatacatcttcttctaaaagtaaatcacgttgttcgtaccattcaggtacaagtcttcctgcgctatttacaactcgatgacatggataatctccatacatagaagcatgacttaaaatttttcccactaatcgcgcattcttgggtcgtcctgccaacgatgctatttgtttatagctggcaactttcccccaaggtatttcagacacgattgctaatacttgaaaaattaaatcctcatccatataatcacctcctatatttttattttatctaattatcgaaaaaatgcaaaaaaatttatttttttgtattttattatacttttttgtataattattttattagcttgggaaaggagatttatgaaacagtttaaaaaatctttattaataatcggattatgctttttaatgattggctgcactaatgatgccatgagtaaagtaactaaaaagcttcaagatgctggatatgatatttcttatttaaccgatgatttcacagctgtaaatattactaagacagaaaaggataaagaccgcattcaattttgtgcttatttagaaaagaaggttgttacttctatttcatatattgtcttacctgccgataatagtaatatcgataaaacgattattggttttatctatgtcgacaaaaatgatgataatattattagtgaaagtgcccaaaaggaagctaaaaaaatattaaaaaaattagatttatctatagatgatctagtaaactatgcccttcaagtccatgaagataaaggaaaatctttaaattcatagtctgaaagacactttttaagtgtcttttattatttttaaaatataaaacgatctcactttcatgagatcattttacactatggatgacatctactgcaagggcgatatcctgtatttattgcagtagattttgagatagctattttactacgtgataaatagccacaaccacttgaatgatagcagtctcctgtcttagtaatataaacagttgtagaaatattatcatctgccacaggcgttcgaatagaggatgtttctaccggttttccttttacggtcacattacatgtaactgatttatttttaattgctgctgttatttttaccgttcctgattttaatgctttaatatttccactttgatcaactgtcgcaatcgtttcatcactagatgtataaactaccggttgagtactatttgtttttatatttatagtattattttgattttcttctagatttaatgtagtagttgaaagctctaattctaatgccttaatacttactggcatgatcaaggtagatgtatttccgtatttatcacttgccttaatactagcattataatttccagctgctaaataacttacaccactatcatcaatttcaagctcatattttgatagttcttttatttctaaataatcacgataatctatttcatcattttcgataatatcaatttcttttgtttggattaattgcggtgctgtcgtatctttgatattaagcgttaatttctttttactattaccatatttataagtgatagtatatttacctactgctggattatcttcatcaaaaccatcacagctatatgaaatatcttcttcatcaaatttattcttatcaacataatctaaataattaaaattttctccatattctagattaacagtattctgtttaagtattaatttcggttgctctttccccaatgcaccaataatacctaataaaataataattatgatcgttaccttgatcttatgagctaaaatatagtcttttattttcttcattttatctttactctcccataaattcacataatcattatactattacttatgaaaattcacgatatttttgtcgtaaagatacggtttattacgtaaaacaagataaaaagataggatattaatgaaacgaacctatctttcttatcttaattatttttatactgttttatataattttgataccaggcaaaactatctttcttatatctttgataacttcctttaccctcattatcaccatcaacataaattacaccataacgtttttccatttcacaactgcctgctgagactatatcaatgattccccacataatatagccaatgacatcaacaccatctctgatggcttcatcaatttgttggaaatgctggtttagataatctattctatattgatcatgaatagagccatcttcttcaaacttatcatgagccccaaaaccattttcagaaataaatacgggcttgcgggtgcgatcatacattttatttaacatgattcgtaatccaattggatcaatttgccaaccccagtcacttgctttcaaataaggatttttagttgaaacaactaagttacctgctgtttgctcactgctctcttcaaccgttgcgacggcactagaataatatgaaaagcttacaaaatcacaggtattatctcttagcagcttacgttcttcctcagttattatgatattaatcttattttcttgaaaaaaacgattcatataactaggataatagccattagccaaaacatctactgcgaaccattgatgaatttgttcatctctcactgctttaagattgtcttctgggcgcggtgttaacggatagtaacaaaaacaagctaccatacagccagattgactttgagaacttattttatgccctaattcaataaccttagcactagcaacgaattgatgatgcaatgattgaaatactagactttgatcgtatggtcgatctttctcttttactaaaccaactccattatatggactaaaataaccagcatttatttcattgaatggtaaataataatcaatatattctccccaatgttcaaatacagttttagcgaatcttaagtaaaaatcgactaagatattgtttgtccaaccaccataggtttcaactaaatacaatggtacagcataatgattcatggttagaaaaatcttcattcctgcttgatgaacctttttaaaaatatggtcataaaaacgtattccttcttcatttggcatttcttcatcaccatgtggatacaatcttgcccagctgatagaaaagcgataaatatcaattcctaattctttcaataactgaatatcttcatcaatgtgatgatagccatctgatccttggcggaatggataattaccaacttctttacatgattttgcttcatcaattatatcttgggtcaataaccttgttgaagttgtagcattagacgttctttttaaataaggtcgacagtcctgagtatctaaacctttaccacccaaattatagccaccttcatattgactacttgcagtagctccaccccatagtatttttctttttttattcatttgtcctcctccttctaaaaataaaggtgataaaaatcacctttattttttacctaacaagtatgctccatattctggactgtataaaggggcaacaagctgacatgatagtggctggagataattattcaatggctttaatacataatcttctccatattcaaaaactccaccaatatacgatactttaaagggagaagtaaagtttttggccaatgttttaattagaacagcaatttcataagctgcctctttatatatttgtaaagcatatttatcattatctttagctgctataccgtttagttttgctaatgaagcaattgatgttcgatcatgattaagcttattaataaaagtgataatatcgtaatcattttctagtttacatttttctttaattaaatagtataactgtgtcttttctagtcgaccatcaacttgttggcaatagagggctaacatgcgcttggcaatccaataagcacttccttcatcacctagctggtagccccatcctccacatctagtaatatggttatttttagatgataatgcgattgaacctgttccagctacaactacaatcccatcaccaccacctaaagctccagtaatagcaatcctaacatcactgtataaggagaattctcgatttccaaatgcttccttacaaatagtcgcaattttatttctaacttctttttgttctccatatccagccagccctgcaatcacttttgcttgaaaatttgcatctaattccatcacaccatcttttaaaatttgaatacatatttctcttggttgtgttaaaacatgtactgatggctttattatttcttttaattttcttcctgcatcatcaaagagtgccatctttgttttagttccaccaccatcaataccgatatacaacataaataactccctattttctatgcacttactgcttctttagatttttcctctgctaataattcattatcgtacattttaaagaacggataataaataatcactgatataataattaagataatatttaataccgcagctcgccagtcaccaccgcaagccaagtatgcaccaattggtcctggtaatgtccatggagctattgtaacagcacaattgactaaatgcatagaagttgcaatccaggcaatagttgcacaaattagcggaataataataaatggaattagtagcattgggtttaaaacgattggagccccaaaaatcatcggctcattgatattaaatattgacggtaaaatcgttgttcttcctaatgttttaccatatttagattttgcttttacacagaatagtattgctaatcccaatgttgctcctgaaccaccgatatgaacaaaccattgtaagaatggttctacaccaatatgagtagccgctttaccagctgcaattgcagctgtattttgatctaataaaattaaccagattggtcttgctagcgaagaaacaatcgaatctccatgaataccaaatgaccagaaaaacataattaaaaatatgattagtaatgttgatggtaaggtatctgttgcatttatcaatggcttgattaagttaccaacgatagtatgcacattgatacctaaccacattgtaattgtagaaactcctaaaataataataaccgtaggagttaacgattcaaaagatcttgctactgcagggggtactgccgccggcattgagattttcaaacctttaacttgtgtaaaacgataaatttctaccccgataaaagccgagataattccaataaacattcccgccgaaccaagattttctgctggaataacatagcctgaaggcaaacctagtaaaaaagcatttaattcggcatttttactagctaatgcactaattgactctgtaatatctggcatcgaaactggtacaattgtcaataaaaaagttaattcagctaaaatcgcaccactcaagccatccaaattatatgatttagcaagtgaataacctattccaaacactgcatatagcgtcataatatacattgacattctatatggcaataaaattgctactgcgttatttttaataaattgggtaatgccccaatctgcgggcatttgattatatgaaaatgctacaaccattaataatgaactaacaataattaatggcaaggttgctataattccatcacggatagcccgtaaatgtctttgattagaaagtttttcaagtggtcctgctagttttccttctatcaaattagatatttttgtaaacatcttattttcctcctatttaatcatgaatataaccataaaagcaatcaaactaaatatagttccaacaatccaaaagtttttgcatactcctttttttcgctcaataaaaaattgtgaataagctacgctaaagccacaaacaataccagaaattaaagcattaggaatacgaaaatctatttttaaataatttaatatgtttatacaaatcaataatgacaacatagtcgtcattagaatgaataaagcacttttaaatccaaacattgggatatcataatctgttttgccaaatatatttttatattcttttttggtattgtttttgactacatacttattcatatacttattctcctttagttatcgttcttatagtttgactaatattttcatcactatctttcaatgcttttaggcattcttctttactcatattagttagaccctttaaaattgctatttttacattgttatctgcttcaattaataattcttttgcagttccctcatcaacactaatagcttgctgaacaatatttatagctcgaattcttagtttttcatttgttggctgtacatcaaccatcaaatttttataaacttttcctttttttatcattacagatgttgataacatattaaggattagtttttgtgctgtaccagccttcattctcgtcgaccctgtaataacttcagggccaacaactgcttcgattgggaaatgggcatgttgagatattgctccgtttttaacacaacatattgatattgttgaacatcctagtttgcgcgcatacgctagagcgccaacaacatatggtgttcttcccgaagcagctattccacaaacaacatccaatggactaagttctattttttttaaatcatcaactgctatttctttagaatcttcagcaccttcaattgcggttgtaaatgcttccttaccaccagcgattagaccttggacaagagtaggatcaactccatatgttggcgggcattccgatgcatctagcacccctaaacgtcctgatgttccggcacccatataaatcaatctaccacccatacacattttttcatagatacagtcaacagcttttgcaatttgtggtatgacgtcctttaccgcaattgctactttttgatcttcttgattaataaccgttaaaatttcctctgttgtcatttcatcaatgtgcaaagaattgctgttaatttgttctgtatctaattgacttaatttcatccattccactccttccatatttattatatatctattgaaatattgtttcaatataaatgttaaattatttaaaatattatttcattataaacaaaaaaaagaaaagcctatattttagaaacaattctttttgtttcaataagcttatctttatttcctgttagatcatttttaaatacaccataatataataaatctgtcattactagtgatgagattcttgatgaaatagctcccattcttatttccttttcttcattaggaacttgtaaaataatatcacttaatttcgaaagtggattgggcttaaattgagtaattgatataattggtacatttttgttttttatcattttagcaatttcaacaagtccctttgtagtacccgaataactaataaataatgctgcatcctctttattcatactttcactaaatgttagttgaacatgtaagtctttattatagattaccttttttccaattcttgttaacttttgttccacatcttgtgcgacaatcgccgagccaccgacaccaaataaatatattgtattagcagcaatcaattttttgattgcattgtctaattgattagtatcgatcaactggtatgtctttaaaacagtattcatatttaaacgacaacatttatcagctaaagttacgatatcgtcattttcatcaataataaaatctattttttcttcaggagcacgtttagactgcgctaaactcattttcaattcactaaaaccgttataacctaatttttttgaaaatctaataattgcagcagcagaggtacccgttttctcccccagagattgcgctgaacactttaaaacatcagcagcattttccaaaatatacttagcaataaccttttcagttgatgtatagctgctttgtgcctcttttattttagcataactattcataataatcttagcccctttctaattaattatatcaatccactagtaaaattactagatttttcaaagtattcataacttagttttaatttattctattttactatattcaaataaaaaccatctatttaacaaaatagatggctaattgtaatattttgattaaataacttagacacataaaggttatttaattaattgtaagatttctgtcttagtggagaattggtttaaaaattcatcataccaattttttatattcttcatttcagcatattgttcaagtgtcggctcgccttttaagaatgtattatcagaatactgataaataaattgtgttgccccatttattgagtaaccacaagttccttgttctggaagatacatatatccagtttttgcttcaagatcgaaagcagcatcaattaccatacattttttattagaaatgacaatcttataagcttcggttgaacttattatctgtcttcccttattatccttttcataattatagccattttctttaattttcgtgaggactgtatcagcatctttttgtatattttttatcaaatcagttcgagtattttggttaaattgaattattgtccatttagctaataactcagaagttaatcccaatttttcaaattttttttgatatgcttcataagcttcttttcttcccttatcattataagttttaatatcttcttcatctacaacaaattctccatttactggtcgtagatatatccattgactccctatatctttatctggatttattttaatacgatcaatattagcaagcgttaatgtattagttacatagtagaactttggatcatctccaacattaaatgccacactaaactccattccagcaaaactaaatttccaaaacaaacctgaattgtcaaagccttcatcatttaaatcattatcttcggcaatcttagcaacatcatcagtagtttctgctttagctgctttcttttcaccacaagctgttaaacccaagcagatcattgataccattaaaatttttataagttttttcatattttttccctttccctgcttaacttatgaatttattttaatcttattactatcacttccaatcgataaaattttactgctactaatcacataataattatggcatgctttatttagtaaaacaaacaatgttataatatttgttcaatcaatttgggaaatataattatttaaagcaaaaaaagagacttactatttatttcagttcttatccggcttagggtaagaacctttatttctagttaagtctcttatataagaattaatttgttggatatgttattgctaatctagttaaaatacccttttgattttctgtaacaaactcatatttgtatccttggtcatctgtataatgccaatgtccatctgtattttgttgcgggctaccaatccattttaacaaattactacttgttgttttcccattcattggtatttcttggtcatccttagtaataaatactgttgtctttataccgtaatgattctcttcttccgtaattgtatcataatctaaagtaatttgcgttactttacagtccgcaactgattgctttttatctgtatcatttttataacgaattccaaaccattgccaatcagaatcatctaaataaacttttaagtaagctaccatagatgaaataccaccagcatctaccttaggcgcctcatcaactgatttaccagtatcacccaattctactttagttccaattttttctaaatatttaacatactcgccgactgtttcaggcaaacatatcttttcatcattaatagtaaagtacttaattaatccatttgattccgtaaaaggtctctcttgttttgtgttatcagaagtattattatcatttggtttgtctgaatcagaatccttagaactacacgctgttacagcaaacatcattgttagtgctaaaccaaccgttaataatttttttagcatagactttctccttttttatttatacatatacagattttattataaatacttttttcgatttaatctactattttttaaatttaaatcttatattttcttaactattgctattttctgcttttacataaaacttattaattagatttgatataaacttaggccagaatttttgaaacattactagatcttcctttgttctaattcgatcattaatgatttctgtagtcgtagattcttcatgaacacgatgtcccattaacggattattcacaaaagtaaatttaccatcttttaatgacagcttttcccatgcaaaccaatcaacatcacaaacaaagtcacatttaaaaatatctttggatttaatattatcaataacaaaagttactgctggacagcatattgaattaccgaaacgcaatgataatcgtttaccgaactttgtggatgatatctttttacttctcatcggcaataaaagaattcgttttattttcaaattaatattgctatatacgttccctttatccctaatttcatagtaatcactaaatacaattaacgaattaggatttttaaggtatgcttttactatgcaatcagaatattcgtaatcataaatatcatcctgatgagcaacagtagtcagttctgtttcgccacatgaaacagcaaaatcaaaatcatagcctattccttttccaggattgggattaactttaatagctaatgaatatttatctgcaatattttcaatatattgattaggggtagaagttgctataacaactttactaggatatttttgattcaaaacagatttaatacattcttctaaatatgatgattctttataagctaaaaccacaaaagtgtgcataaattacctcctaaagggtattgataaaatctgttatttcatcaataattccctgcttatctgctacatattctttcggttcgaaattataagcattattaacagtttcgtcaagcttacttaaatcagtacatggtataatatacccctgcttatcaaacctctccataatttgtacttgatgatcattattttgttccttatattgtccaagacgaggtacaacaataactcttttttttagcttaagtgcagatactatcgcccctactccagcatgggtaataattaaatccgcaatttcaatttgatgatttaattcatcttcagtatagtactcttgaccattaattcctgaataatcaccttttgtatatcccagctggacatacacttcattctcattaacaaagttagagttaagaattgcatttaagagacgatcaaatcttttatcttgagttccaaacatgacaaatattctcattattttagacctcctcgatatttagcttttggatataattccaacatttcttcccattgaaccaaaaataaatctgcaattggataaacaagctttccagataaagttttagtagtgatattcgcaaacgtttcgataaaaattacttttttgccaaataatttcgcaatgtaacagattggtacagtcgtatgcgcccctgttgcaataataacatctggtttaacttttaaataagccttaaaacttttaaaaatatttatggggaaattacacaaaaacttaaataaatgctccttagttcctgctggcatataccaagaacgagatttattagtttttttgtactccttcatcatctcatgatcttccgtaatcaaaaatgagttgtaccgctccatcagttcacttaattcacacaactcactaaaatgcccaccagcagaggatgtaaaaattactctagtttttaaatcgtgaatattgaaattattaaattcttttaaccactgcttttttacattttgataagaaaaacgtttagcttttcttatagcattattttgcaatgttttagttgttttgtttaaaagttcaactattttatttgccatctcatcaagattacgatctctaataataaaaccatctttcccatcttcaataatatctaaagaacctttcgcactatcgaaagacacacatggaataccataactcattgcctccaataagactagaccaaaactttcataatgtgatgttgtaacaaacacacttgtattattcataatctcatttttagcttcacctactgtatttccatgaaaaattactgaattactaatagctaattgatcagccaatatacttaatgaagctctttcttcaccatcccccaaaatattcaatttagcatcaggattttgctccaatacctttttaaataccctcaacatatcatcataggctttttctttggatagtcgtcccattactgtaatctgatttgtatttaaagaaacacgatttcttgggatctcatcgatacacaatggtaaataaatacactgaggtcctgttaagtattctttataaaattcatagattgattttgaggctggaataaataagtcaaactttttaacagcacgatatacttttttaggatattttggatcacgatctggatgacaatgctcccatgcaattaataatttgtttttctgatgttttgaaaatgctttatcaaaagcgagggtacttgaaataattatatcagcatcatttactttcgcacattgcctaattaagctccgtttctttaaaattattctgaaagctttgtacccttccttgattattttaataaatcgcttattttttagagcatacttaaattcttctttatttggttttaagtctgttgataaatagctaacattaacacgttcatcaatataaaaagatggctcacacaatttatatacatttataatttcaacatcataattatccactaacatattagcaagtgagcaaattgccttttcaattcctccaacctgtaaatgtaatgataatatagatattttttgttttggaccattatgttgactaataatatctttttttgtccttagccgagcaaagctacaagcccaattagcggttctttgcaacctctttagcttatgagcagaatgtttaaaacatgttttatggtaatacatttgagaatcttttaaaactcttagcttacgataatgattaatatttttatcaattgttattgaatgattatgaatcaccttaacattatttaaaacacaagcatgcaatccagcattcttagcttttgcacataaaatatcttcttcatagaaaagaaacgttccttcgtctaagaaacctattctatctattaaggctttttttattccaaaaaaacatcccgaaatacaatctacaggagttgttgctcctttataatatgaatttcgatatttaatcttatttttgaacaacctatttacaataggataattatcatgaatatcatacgcaatcgttctttgtttccaaccacgatttattgtcccttgttcttcaatagttggaccgaataaatgatagttagtatctgcattcatatgtgcaataaaatccattaggtttcgtttatcaataataatatcaggattagaaataatataattatcgcactcttgttcataaagatactttaatcctgcattattaccagcagcatatccttcattggtatctaacgcaattaattcaatatttttcaatttctttagttgttttactgaatcatcagttgagcaattatcaaccacacaaataatatctacagcattaaaagtactgattttttccacaaaatcaattgtctcaattgcatcgttatagtttaagacaacaatacctgttttcatctgattgccctcctacttctctaatcctaatatagtgtagtcataaaatcgagacgttttttgaacttcattattcagttcattaaaccctatctcttccattattgtttttttatcagaaaataaattagttcctaatcccaatctatttccttcaatacttgcccccatcgccactaacattgttggatacatatcaattgtgctgaataatctattcttattattgacaggttctacaacactgttaataaagcaattatatggtgttctaacataatcagtatcaattcccacaaaaaacttttctgacatgctattatgatcaccagtaatcactattgttgtattttcataccattcttgcgttttacaccaattaataaagtcattaatttgttttgactggcattcaatcacattggcatattgatttttgtgagtatttttacattgatcacataaatagccatctggtgtatgagtatcaatagttgtaatttccatattaaatggtttttctccactcgctaacttagtaatatcttttttagcaagctcaaatagtttagcatcttcaataccccaaaaaacgaaataatcttctggtatttcttggttttccttaaaactattatagtctctgattatataattgccatgttgtttatagaaatttgaagttccaccaaagtttgcatcagaaccacacatgaattcatttatatatccgttcgcttccaatacttcacctaatgaatacccaccaggcaaaaaagctgtatcattatcatacttttgactttttattgataattttaaaggaatacccatattttgcgatacttgagaggcaatagtccattgagttccatcaatagttctacttcctccaatgttgtcattgttagaaaaattaatattattttttgctaattgtgacagctcaggtatatagttaatttcctctgcaccaccaaaggtagtattggcatatgtattctccactgattctaaatataaatgaataatattacgcttgccattattaaagctaattttagcagtgcttggatcaacataatatttttcatatatatctgtttcctgtactacgttattaatatagccatatatatcataattataaattgcaaagattaaagaaattattatacataaaatacctcctttgataaaatgtttttttattgactgagatattttttcattatttcgcttacataatctatgaatattaaaaataagagcaactattaatgatcctgcaacaatactaataggtaccgcccaaatgaaccagtctaaataaattccattgtctgtgccttccataggaacttttaaatgaaatataatttgatttaatgtttttactgaaaaagtacgattgccccatattattgatgttacaattagacagcctaaaaaaattagaacaacgcctactatatactttttttctattgtttttatttttttcatatgtacctcataaataattcctttctattttatcatatctagctctaataataaacaaaagaaaaagattgaaataatcactattatttcaatctacaatactagtaatattaaattccctatagtaagaataggtaaaataacaataatcattaatacaactttagtaacacgttcgttcatgtatagtttactattttgaaaacagattagtaataaaaaaataatcggtataaaatatctcccttgcacaccttcaatcgtactatacccatttggtgtccaagctaatgccatagctagcattacaattaaaattattgtcacagcaatgaaaaaataaagtatcttatgttcgtgggtaaatacatcattatttgatttttcagaaaatgtgctaataattaatattattccccaaatattaattatccaatttggcattaaaatatttagccaacccaactcacttccaatggcagtattgatataccacatccctttttgaagaaatgtattcaaaaatagagaaaaagttgcagggatatccccaattattgcatttaacgtatatgatggcgttccagcccacggaacaattcctgcactagaaaccgattcaattgcagtaacttgattattatttgtaaatgagtgatagtttagtatcaagatgcatatcactactattaaaaaaataactatttttgtctttttggctatcctatctccaccaggattaaagtattttgcgagaataggaataactaatataaaagcatatgctgagcctttatttgctagtagaattaatccagaaaacccatatattagtatatctataaattgaatttcttttgcttgatatacaaaaaacataccatacgctatacatataaatgctgatgaattaactactgtatcataagataaactaaacatttgttgacaagtcattggcaacatagtgattgtgaacattaataatttcccaaagggtattttttttattgatagataggtcagcagtatgtaaaatataaaattgaataatctcccaaagtaaacggttgtcacaacaccaaaatgcaatattctcgcaaaagtaattcctaaaacagctggaaaatatgcaaataattgagttattccaaaagagtcaatttctgtatgaatatacgcactattatccgttgaaattatgttattataaataaaatcatagtatcccttggctggattaatcacttgttttgaaagaaaatttaattccgattctctcattgtaactttcccatcaatttctttacctagcaattgactagataaagaaaactcattttgcatatgtgcccattcatctgggactatccctggaggaattaataatgtataaatcaagcctatcggtattacacaaattataaataatttttcaattctactattcttttgtaatatttctttagcccctaacaaaagaacactcatgacacatcctaatactataattttaaaccctattaggccatctattgaccatagcgtagtaaaataaaaaaatacagttattattataattgtaatagtgatagttttattgttctttataaaactatcacttaatttcttattcatattattaatacggtggattttagcgtgtttcattatttactcctaaaaatgctagcattatattaaaatactagcatttatattattaataatcaatttcttttaaatatctactcaatgcatcttgccatgttggtaaacgtccaaatccatttttatctagcatagccttagacattctactgttatttggcctcttggcttttgcaggaaaagcattagaatcaactggtgttacttctacactcatacctgcttgtttaaagatttcacacgcaaattcataccaagaacataacccttcattagtagcatggtatattccatatttatcagtttgaatcatatcaacaactaatttagataaatcatatgtatatgttggtgaaccgatttgatcgtcaacaacacaaacagcaccacgttctttaccaagtcgcaacattgttttaatgaagttatttccattaataccaaatacccaagcaatccttacaataaagtgcttaggtaacgtttctacaataagttcgccttcatatttagtttgaccatatacatttaatggatgtctttcatcatattccttccattcagtttcaccttgaccatcaaatacataatcagttgaaaaatacatcattggaatatctaattctttacatatatttgcaatgtttcttgtaccatcaacatttactttagtacataattctacttcatcctcagctttatctactgctgtccatgcagcacaatgaattactgcattataattaccagacttgatcacttctgctacttttccagcatctgtaatatccatttcctctacatcgacacctactgcttctatatttctgttattacattcattgacaatatcatgtcctaattgacctttaacgcctgtaaccaataatttcatttattttctcctctctgctaatttagctctaactccattaaaaatagtatctttagcaataataagtaataataaatatatgataccgcccacaaaaatttcaattaatgtactcacaattgacatacttaaaaaattagaaataccaaaaacaactacaaacattattaaactgaaaaccaagtatctaaacccttgctttagtatagaaaaaatattaaagtcctttctaataaaccatatttgggttaacaatgcaacaagttcagcaaaacttgtcgcaatagccgctcctaaagaactgaactgaggaatcaaaataagatttaaaatcaaattaataattgctgcagctattattgaaaatgtatactctctctgcctccctaatgctaataaatattgtgtcccagtaactgcacttaacccaataaaaattattattggagaaattagcataagattaggaattactttttcgaatccatttccataaaaccatggtacaaaaccaggagctattccaatgatccctagtacaaatggaaaagagaacattaaaataaattttatagacattgtcatataattttttaccgtttccatatcatccgttgcgaataaattagcaattcttggcatcattgcagtacttaaagatgttaataaagttaagactgttttaataataatttgtgactgctcataataagcaacttctgaattattatcagtaataagcccaatcatagttttatctaataaagtatatagtgaactcgcaatttgtggtaaaaataacatcacagccggctttatatgtctctgaatattcagatttttcacatcattccttttaatatatttaggtatataaaaccacattgatatattacctaaaagtaaagtaatagaataaaacaatacatataatggtaaatcagcactagattttacaaacatgaaaattaaactaacgcatactattctagctaaaaaatttcttaacactgtctttttaaagtcttccattccctgaaaaaaccatgatacatcaaaaatggaagcgataatatccattatttgaataataaatatgtatgcatattgaccttctctagcaaatgtaatataaaatacaatcaagctaattataattgtaacggttctaaggaaaaccaattcacaaaaaaccctatttctctctcctatattattttgacgatatgcaatttctctttgaccatataagtttaatccaatacatccaaataatatgaaatattgtgtaattgaattggtatatgcatatgttccaattgcttctgctcctaaaacccgggaaacatatggtgttgtaataataggtaaaacaattaataataattgatagcttaaattataaagataattttttataaccttattcatttcactctcctattctactgtgtctacatggtccagtatctcaacaaattgattggcggatttttcccaacttaatgataaaatactcttattagctctaatagtcatttcctctaattcagcagggttttcaacataataaagtatttctttttctaagtgcttataactcaaatcacataatattgctgtttctttactaaaaaaataatcaaatgtcccatctttaaattcaataacaggtaatccagctgctatcatttcatatggaactaatgagatattggttaatgaagccaccataccaaaatcacattcacaatataattcatgaagttgcttttttgataactttccacactcaattccattatttatacatataggcaaagcatttccaaaataatttatttctaattcaaagcctttcaatttcaaactcttttttaaattgtctaaaattaaagggattataactggtaatcttttggattcctcttttacatatacagccacttttatctttcttttttcttttattttttcaaaatttcgtttaacaaaagtatactctgttttctcatacggaaattcaatataatctatttgacctttgacatcacagcttttaacaactgtatctacattccatttacctaaactgacaatgtgaagtcctaactcataagtttttttggataataaataacgttcacccatctcaaagaatataggttcaaaatcttggacaaaatacatcttataagcatcaaaatccattattctatataccgtccgccactcagtcgctactataatatcaaaatcatttttattcgttttatttaatggcaaacattcaccttcgtaattacttaaattaaactttgcggcttctaccatatccttttcattatcattaaacattgatatgtatgttaattgatatcctaattttgatagattagttcctaatctgagtattgacgtaactccaccagaagatttaacaagatggggtaataatatacctattttttttccaccattataattattctcaactatatcaaaatcacaattgtctattataggtttataatctataatattgtttcgatatctagttttttgaataatctttgtacccaaatccaatatatactttttcatatcaaacctcctgtttaaatttttttaacaacacaaattttaatgatttatatttctttatcattaccagtttataagctaatatttgatacagatacattatatagtcttccttataatactcttttaaatcatgattgagtatacataatctcttataggaagcttctagactatttgactccattgaaaaatcttgttttaaaacattatcattcataacgagtatattctttttaaccctattcatttctctcataaaatcatgatctaaataatctaaaaatatattttcattatatttataatctttatagatttcactctttataaccattccactattaattgctgaaataggtttattaattagctcttctaaatttttaacctctacacacctttttttcttaaattgacatggcgataaaattctagtacttgttttaactaccggtaagagaatatctgcatttgacatatttatataagaaagaactttatcaaaatatttcttacccatatcagtatcatcatcaaacaaacaaatatatcgattatccttgtttattacttgaatagctgcattatatgctttactcaagccattattaccacccatatttatataaatattcccatcattctttactatttcttcattgccataatcactagtactattatcacatacaatgatttttacactactatcctttgctctattgtagctaatggaatcttgacaggatgtattgtacacaactataaccacatataaatcattaatattatattctttcaaaaatgttctcctccatcttatttacctttacaatatattttagtaaatatacttactaatccaattttagataaaaagttaaatatgcttataattaatctgtttttaaatggttcgctttttatctttttagaataaaatggtatagaaagtttatatccttgattctttagccattcaaataaacgcttatattcttccatgaatctttgtggtgtcgcatcaacaccagaaaataataaataccatatgatatgtcttgttacaaaataattcaaatattcatctttttctttatatagcttatcaatctcatttagaacaactaggacatcacattctggttttaaaccacgttgcttgacgtttgatacactttcatcgttataataccaattataaccaacataatccagaccatgaattttattagtatataaatatgcattcatattaaaatacgtatcttctccaatataggtctttaaaaacctaacattattttctactaaaaaatttcttctaaatattcttgcccatggtgctgtaattcggtatttagtccattcatcatcatatgcaggaatagtaaataaaactttatcaaagttagctcgacgataccccgttattacaatatcactatcagttttttcaatctcatttaaaagaacttcaacataatcattatctataaaatcatcattatccataaacatgatgtattcagtatcagcttctttaattccacgatgtctagtttcaaccactcccatattttcatgagttaaaactttaaaaatatctggataacgattagcatactcagttattcttattaatgaatcgtcagttgagccgtcattaattagtagcactttaaaatctctactagtttgtttcagaatactctgtatacaatgctcaatattagcacctgcattgtatacaggtattataattgtaacttttttatccattatttttttcctcattaactatttttttctttagcattgaaacttcttgaattagtaacgtaatttttgttgcttgccctgatacaatcacagttaaagctatgcacattgcaaataataaaaatataagtattccaaccagcatattggacatagatataaaacctattctagtagatatttgcactataaaatttggaaaaatccctacaactaacaagattactgctacaataaaccacaaaatagaaaattttactggtattcttccccttcttaataattgtaatgttactaagaatattaataaacctgttcctagaactaaaagtactgttccaaaactcattatttccacctcctaattccgacaacaaaaaccgaaagtataatatttaccatgaagtatacatttttccatgaatttattgatgaaattccagcctctctctcatgcatctttactggtatttcttgtattcgtacgcccttttttagtaattctgtatttgttattggttcaggatattccaccggataagataacgcaaagtctaaaataacccgccgattagctgctctaaagccagatgttatatcgtgtattctttttccagtaataaactttatcatatttgaaattattctaatacctatccttctagcaaaacttgacttaaactcactagagcttttatcaataaatcttgacccaattacaaaatctgctgaatcattatacaatggttctaaaatatccttaatacacgaaacttcatgttgcccatcaccatcgaattgaatagcgaaatcatatccgttatctcgcgcatatttatacccagtctgtactgctccacctataccaagattatggatcaaattaactacaggtatattatttatttcacaaatatgcttagtatcatctgttgatccatcattaatcacaattacatcataattagttccaaactcattattgtaattacaaatattcagataaacctctgcaatgcttttctcttcattataggcaggtattattataagaatcttttgctccatcattattctcctcatatgtgataatctctttgcattataacaaatctaaataaatgtgtaaatgaaaccttgattataaacccaatctatattaaaaacgggaaagtaacaaactaacccgtaaaatcaacaataaatgcattgtaattaaaaattataaaccagtaataaaattatataattaagtaaaattatgtcgataaaagaaaatattgttgaattcttaatagtcaatatttttttcctaaatgaaaatatcattattgttggtaaaattaatggtataaaataccttccttgtactccttctacgtatgacaattgatatcctgaccatgcaaaatatagagcaccaaaaattcccgcaataactgttaacactattaaaaaataaaatattctttcttttttcttaaaattactttcttccgtcagtattagcccacctgccatgattaaataggcatattgaaatattgtatgcatttttatagaaaagtatccaaaataaccaactaacgaatcgatataaaagacgattttttctttaaaagtattttttgcaattgaaaatatttctaatggattatttaatatatacgtaaaatttgattgttcatttccactatttgaaactacagaagtggtcaacgcccctatactcataacctttgataataacaacgtcgatagatatgtagcaaataaaacaataaaaatacttgctgtcttttttacactattattaaacttataagatggtataaagaagtataaaactcctaataatgcatatggtaattttatactaattatcataaatagcattatcactgaaatagacaaatatcttttatttatcttattttctttatcatatatcatttttagacatgttgctataaatagcaatatacatgcatttaataatccatcgtacgaatatgaaatcattgattgaatagacatcggcatcaatgcaactataagcatcgtatttttgaacttaggagttaatttaattgcatagtaggtgagaagaaaatttattcctaagcagactaatctgcctgtgtaaaataaaactaatggtgagttcgtaaaacagtcaactaaccttaaaataatagaaggtaataaataagcgaccattacagcacttccacctatacttgaattatatcttttttcaatatttcgcccctctaccatgctatcacctatcaatccaacatccgtgactgcatcagttgcttctgctctactataattaacatcatctaagttgtctggtacaattatctctctgcttcccaaattttctgatggtgtttttgaaaaattatattgagataattgtagagtccttaaataatgcaatctctcgtcgggaacttgatatggtggcgttaatatagttgcaaacgcaataaaaattaaagctaatatcaaaaacttttcatgtattatttttctttcattaacaatcttcatcaaaataaaaaacaatataatcattccaatgattataaaagtgcttatgttcaaaggacttttgcttaccttatacgctaccgctatatccccattttcctcattacacaaaacagttatattattactagtatctgttttaattggtgatattttcacggtataatcttttagacgcttactatctattgtatcattgagataaaaatcctcatactcattatcaccaaatttttttgtattgaaatttgtttcatatactacattatttttgtccattaccgataaagtataatctgaatcatttattctatcatatgttgcaaatttaatacttaagatatcaaaatcttgatcaacattttttctatctaggctaaattctattggttctttatatatagcccctacattactcgaatataaatgattatttctatatataacactattattatttgctgcatactcattaaatataattataaatgaacagattaaaaatataacaagcaaaaagtttttaggaaaaaattttaaaatactacttgcaaaagatttatccctatatatttgccattgataacttattttttttaaaccattaaatatttgcgacaaaatatttttaaacttcatccctaactccttatattttttttaatctaaacgctttttcttttgaaaggtttacattataatatctatcattccctatatgcattttattctttctttgaaaaattttctcttgctcaatatctgaacttcttttgtatgctgtattaataacttctacttgtggtaaaacaacatttctcaaaccatcctctaacaatctcaaacataaatcatatagcgaaaaatctaaattaaaatcggtatctaaattatgtattttttcttttgaaacacacattaaatgactacttactatagaataattatatggtactaatagcctaccataattcccataatcatttctactagtacattcataagcatttataaataaagattgctcgcttaatataactccagcatttcttacaatcttatttttatccataactttacaaccaacagcacctatttcattttgttttgcatagccaatcatcaagttaatccaatcatatgtctcaaaattacaatactcatttgcaaatattacgtattcaccatcacttgcttgaataatattatttactgtctcaataacatttttctcattaataaaaagcttaacactgtgattaaaatttgtatctattttcaatggtttgttatctttatttataatatttacaacaaaatttttataagcattatcagtatatactgatcttaaaaaattatttaatgatgtgttattaccttcaaaaacaacaagaatatctacttttggttcattttcgaaaatatattcaacaaagtattgtgtactaataatattatctatcttaaccgaaatagctttttgtttaaaataatcctctaatgcacgttttcctgcttccccagcatagtttttagcaccatccccacctacagctgttgaacctggaatcattctccaatgatatagaattttaggtatatgataaattttatcagtttcatttgatactctcaaaaataaatcaaaatcttgtgcaccttcatacccaactcgaaaaccaccgattttttcaattatattttttctaataacactaaagtgacagatataattcccaccatataatgtatctaacgaaaaatcaggtttaaaatgtggatcacttctttttccacccatgtctattttatcttcatcggtatatataaaatctatatttttatcctcatttaatatattaactacttcatttaatgcatgcggatctaacgtatcatcattatccatcaatcctataaattcaccacttgctaaagataaagcagaatttgttgctctagaaatatgcccattttcttctctaaaaataacttttatcctattatctttatttttataagcttttagtgtttcaattgtatcaatattagttgaacagtcatcagcaatacaaatttcaaaattttgatatgtttgtttcaaaatggattctatacaataactcaagtactttccaggaacattataaactggcataactatagatattttaggctgataattaaaatttttcacttcaacaaatctatcgttattttttagccactcattatattcattctcattttgcatatttaacgttcccttattgaattttattatttccctctttaatggatcatatataattccaaagaccttattaataaatatacctctaggtttatatttttgccatactctttttataaaattagaacgaacaactttaactttaatatctaattcatcattacataagtatactttatatactgtatgtttttttaaaggtattttataatcaaatgatactattctagatctaattttttttatttctttcactaaaatttcatcaggtgatttaattttaatatggttaattgttgaatccgcccaacctcgtataactaatgttggattcataataccacatacttcacattcttctattctatacttcattactatgactcaccacctaatcaatgttcctatttaacatatacaaacctaacttacttaaatttttattgtaatatggatcacattcaatatacttagcccacttcttatgcatataattattctctgccaagaattgtttatacttttcactagttgaatcaagtcctctgctttttgactcataatgaattaattcaacttgcggaataaataaattataatatcctgcatctagtaattttaaattaaaatcaacatcattatatgcaacctttaaagtctcatctagtcccccaacttgtatatatttttttcgttctactgctaaacaagctgccgttacagctgaataattataaggtatttttaaacgcccatatactccctcatcatccctaggatgactaataaaagcatgagcagccaccgcattccctactccgagcaaaactccaccatgttgaatcgtcatatctggatataataattttgctccaactgctccgatatgtttctgtattgcataagataccatcaattttaaccagtttggcgtaagtacttctgtatcgttattaagaagtactaatacatctgacttgcatgtatttactgctaaattatttattgcagaataattaaactccatatcagctttaataactctaaaattttcatatctcatttgatatttttcaaacaattccatagtttcttgcttttcgcttctattatccacaattacaacttcaaaattactataatttgttaatttgtaaatagattctaagcacttttctgtcacatctgcaaaatctctagttgggacaataatagatacacttggttctgtatctaatacatactcaatcccataaactgtactattccctaaacttttaacatttgcttttacgcctcgcctttttagggtactctctatagtttctattccctttttcactgcataagctttattatcaactgataaagatgttgagccctcaatcattctccaatgatataagatttttggtatgtgatatatattctttgttttttcagttattcgtaaaaataaatcatggtcctgaactccttctagaccaactgtgaaaccaccaacttctctaactaatgaagtccgcaaaactgcaagatgacaaatataatttatacctaataaagtatctggtgcaaaatcagacttaaagtgcggctcacatctttcaccccgcaaatctaatttgtcttcatcactataaatgaaatcagcatctttatgtttatttaataaagctacattttcatataaagcatttggtgctagcgtatcatcattatcaactaaacaaataaactcaccacgtgcaatttcaagtgcatcatttgaagcctttgaaatatgtccgttaattaacctagttttaactactatacgggtatctttattttcatattcttttaacgtgttaatcgtttccagatttgttgaacaatcatcaactatacatacttcataattttgatatgtttgatttaaaatcgaatctaaacactctgataaaaattttctctcaacattataaactggtataaggattgatattaagggattatattcctgttctttatcaatattatttttctcaaatttctgaatccatttatgataatcatcttgaataaacggattccataatatctcacctcgttccttcactcgactaaaaaaacgaataaaatattttctccataatgttggaggaatcatcatcctatgttcacgccataaaaatctcatacctcgcccaaatacaataattgatctatttattatagaaaaaatctttttaaataaacttctaattttaaaagcataagaaatttttaatctataaacatctatcagacatttaccgcttaaacaacaaactcttatctctttacaatctttaggaatttctaattcaatttgaatatccccatcatctgatatcatttttttattataagcaatttctatatcattactataaacaaagagttcattattttcttttaaattagctagtataatttttaaatattgaacctttatacccgtgatttcatcattaataaaagtcggtgtttttttagttgagtcaacaaagtttgtaactcccattttatacctcctcagcaaaccctttttctagttttctaaatattgctaaccctccaaaaaaacagatagccgcaaatataacaatataaactgtagctcctaaatttggtacattgtgatacataaagatatctcggtaaataaccattagatgtttaaaaggatttaaattaataattttcattaaaattgacggaaagtctttaaatgtactcaaatcatataaaattggcgttccataaaataacatattaataaaaaactgtactatatattctgtatccttaatatacacattaattgcactcaaacctaaaatcaatcccatagttataaagtattgaattaatgcaaatactggaaataggattagatgccatgaaatacctaccccaccaaatatacaaaataataacattattattgacgatatgaaaaagttaacaagcccacttgttgcaacagaaataggcagaatttctcttggaaagtacactttttttataattccctcattcactctaatagtcataataccttgattcatagttgtcgtaaaaaaattccaaggaatcaccccaataacaagatatatcaaataattatcaacagtatttctaaacaaaaaaggaaagactaaaaaataaaccattaccattaacaaagggtttaaaaatgaccacaaaactcctaaaacagaacctttgtacttaccacgaatttcttttttaatatttgattttaacaattccctatattgatataaattttcaattaatttcataattttacctacttttatccttaagaattacttgtacttgtttatttgcaattatattatctccatcactaacttttacataaatgatatgatttccctctaatccctttacaggcacattaatttcccatcctgcttgagcattcatgcttgctccgccattagcttcttgataatgcataagaacatcatttcttttatgcctacttgcacgaccaatatatttattatccatataaacatctacattagttgtaaaagtattacttacttcccaacctgatactacaatattactgctattatctttttcttcaaactccgttggtgtttcaattgttaagatacagttaattgtttctggtacataatctttaacttgattggcatgatccttaactacttgatcaagatatttatcaattacaatatttggatttccatccgcctttacttcaccgttataaatccaaaccgctcttgtacataattttttaatcatatctaagctatgagaaacaataacaattgttttatcactatctctcaactctttcaacttcgaaaaacacttatcttgaaagtgttgatctccaactgccaaaatctcatctattaataatatttcagcatcaacatttattgctactgaaaaagctaaacgcatgtacattcctgacgaataagtcctaactggattatcaataaaacttcctaattcagaaaactctattatttcatcaattcgtttttctatttcaaatttagtcaatccaaaaatagatgcattaaaatatatattttctctacctgtaaaatcaggatgaaaacccgctccaagttctaatagcgaagttaatttcccggcagtttctaattttccttttgtaggatataatattcttgtcattaattttaaaagtgtagattttccacttccatttgtccccactaaagcaacagtatcacctttcttaatatctagatttatatttttcagaacatgatgccattcaggctttgatctattccaaaaaactaaccgttcctttaaagttgttggtttgtcataaataagcttgaaatctttactcatatctcttatttctattgcattttctatattttccataaaatccacctttataaatatacttttatagttttagttagactcttcataattcactgcattttactgcatttttttaatttttgcaagcataccctctatatatacagcctttcatattttttgctaaattatttataagcaaagatttttaatgataatttaattaaattattaccataaaaatccaatttataaattacttcattgattataataccataaacctacactaaacactaacttatttattttatttctaaaagttgtaaaaaagggagctctaaagtgagtgcaaagtttacccacctaaacaagtaagccactttttcattatagaaaatagcatatgcgatgatatgggagggcaaaaataaagataataactcctattcaattagaaaaaatcaacctttttagcattatattaattgaaattgtttagatgttatagctattttttattgtaaaaacgtattaaaaattagtattggtcacatctaagcgtaaattactaatatagtcacgagtactaccattaaatatgatcgattgttgcattcttggataaactcttataaaaaagctataatatagtagaaaaaaaggaaatcagctaccgaaaaaaagaaatgaaagctgtatatccaaataacaaaagttcaattatctaacaaaaaaatgaagaaatattaagtcttaagacaaagaatgagtacataagaaaattacatactgtagttcatacatgaaaacacgacaaccaaagaaaaaggtaaaaattgtaaataaatcgtattgttattacccatcaaagattattctaaatatttccagtgttaagaatcaatacactactataaaatgaataatggttctcagaataccaaaattatggataccatagatcttctttagatttgtctaacatagaatttaaggctaatcataaaaagttaaaaggttgatgtcacactattacaatgaaagctaaatataaattcatatagaggagatatgattagaacagttataaatttttactatagtcgatgaagaaaattataaaatctattatgtaaaaaactttaatatagccaaatgtactgaggtatgacccacagatttattagaagttcatatagttgatagtaaactgtatcaatactctgttataaatttatataatcacgaaatggtattatttaatatatcgatacaaactttgaacaagcagaagatatgttagtaaaatatttaaaaagtatgttgatttaactagattaatatatcattttgattaagtatagcaatatcaaatataattgtatcacaaaatactgaaggaaaacatttaatgaaccaaattcttttgataagagttatagttctattacaaatgttacattaatttctatattaaatgatcttaaacattatacagctacttactcatctattgccaaatgctataacgttagcccttcaacagtagtaagaatatttgataatcatgttcaattaaaaagacaccacttacaagaaatcatatgtatagatgatttctatttcgacagacgttctaaatataaatatgcatttatgattatgggattcaaaaactaacttatcctagatatcgttgaatctagatgtgaagagaaacttaatgattatttcttctccattcctaagagtgaacgtgataaagtaaaatacatttctatggatatgtataatcattaccgcactttaatgagactatattttcctaaaactataatatgtattgacagtttccgtgttttaaagaagattacagattgtctaaattcagttaggaaaaggatattaagacgttacaaagatagtcaagaatacaacttattaaaatatagatacgaactgcttttaaagagtggcgataaaataaatgatgaaaagcacttttttgatcgtacattaggttatacaactagtgaagcaggagtattagaatgtgttctttctataaacaaagaattaaaaatggcttataatttaaaagaagattatcgtgtatttaatgatgttaaagaaaatgaatataatgaagaagaatatctaacggatgtattgaaggaaaaaataattatgtaaaaaagattctatctaatgaaaatggaatgaccaattttgacagagctagaaatagaattatgtattctcagaatcttttagatatgtatacaatttctattaataaaaaacaaatcaagaaaaacaaaaacaaataaaaaatgaaataatactatatctagacataaaaaagtaggataattattgaagattatacatcttctaaccctactttttgtttagtaccctatattattttaaagcgtcgcttaattctactaattaaatttagtccaaacaatttggttcaatagactttttaccataatatttttatttaattatatagtataccagcaactaatatctacatttcccgaaattccaggaatgcttccagaacttgtatattgccatccgaatttacctttatagtatggattttcccatccaattgtatcagtataagcagccatccacgatacattggataaaatagccttatcatttaaactgctattaagcattgctcgataactatatacatttgttgtataaccttttgcattcatttcacttataaatgcattcatattcgctatattttgctcttttgttatagtagtgcgctccaaatcaaaatatacaggatatcctaattcatctggtgtaacattatatttctgaagaatatctattacaaactttgcttcatttaaggcatcattttcactgttagaataatcatatatatataccccaaatggtattttcaatcttctgcatgccgccaaattatttgcaaattgcacatcttctatgtattccccattaggatgagctgcaattctcaaaattgctccatcaatatctccatactgttttacagtattccaatcgatattcccattatatgaactaacatcaattaccttttttgatggcatattcccagctatatttcctttattatcaaaaaagtatttttgcccatcaatatatgcccatccaattctttccgtagtatttattatattatgaaacggtaattctatattgtttactgcacctttttcatcataagcatagatatgcgtgacatacgttccaaattcataattatgatcgcttctatttactctgaaagtgtattcgttttccagtttttgtcccactccccaaattaaatcatcctgttcatttttatatgtccacgtaggaaataatacctctgtaattttattgttacttaaaactgtgcaagtaacagtatacccactatcatttatatttgaaattttgacattctttattattggtttagtacttgtatttatatcaggttcttttaaatttactgtaccacaaattgaaaaaccttttaatccttctctatcatacgcataaatatgagtaatataatcaccatactcaaaattatgatctttacgatttaccgtaaacgtagcaacaccatttttcaattcagcttcatgccatactatatcatcctgcccattgtttactgtccatgttggcatttgaactctaacaacttccaaatcatctgttactttacaaatcatcgtatactcatcagatgtcacattaataacttttacatcacttataacaggtgcttgattttcttcaatttttgtatccaattcaagtttactatattcaccctcatcatcgtaagcatatatatcagtattaatcttaccagtatcataattatgattcatcatatcaacttctattgtatatgtatttccagtcctgttggctgtataccagatcagatcatcctgtccgttgttctcgctccatgtcggcatcagtactctgtctaccgcattgtcatctgttactgtacatgtcactgtatatccgcttcggctcacgtttgttatcttcgcattgcttattaccggtgcttcatttgcccccggtactgtcgccgtcagctctaccttgcttacttttccttcgctgtcataagcatatatatcagtatgatattttccgctgtcatttttgtggtttgatgtctttacttctattgtatatgtatttccgctcctgttggctgtataccagatcagatcatcctgcccgttgttctcgctccatgtcggcatcagtactctgtctaccgcattgtcatctgttactgtacatgtcactgtatatccgcttcggctcacgtttgttatcttcgcattgcttattaccggtgcttcatttgcccccggtactgtcgccgtcagctctatcttgcttacttttccttcgctgtcataagcatatatatcagtatgatattttccgctgtcatttttgtggtttgatgtctttacttctattgtatatgtatttccagtcctgttggctgtataccagatcagatcatcctgcccgttgttctcgctccatgtcggcatcagtactctgtctaccgcattgtcatctgttactgtacatgtcactgtatatccgcttcggctcacgtttgttatcttcgcattgcttattaccggtgcttcatttgcccccggtactgtcgccgtcagctctatcttgcttacttttccttcgctgtcataagcatatatatcagtatgatattttccgctgtcatttttgtggtttgatgtctttacttctattgtatatgtatttccagtcctgttggctgtataccagatcagatcatcctgcccgttgttctcgctccatgtcggcatcagtactctgtctaccgcattgtcatctgttactgtacatgtcactgtatatccgcttcggctcacgtttgttatcttcgcattgcttattaccggtgcttcatttgcccccggtactgtcgccgtcagctctaccttgcttacttttccttcgctgtcataagcatatatatcagtatgatattttccgctgtcatttttgtggtttgatgtctttacttctattgtatatgtatttccagtcctgttggctgtataccagatcagatcatcctgcccgttgttctcgctccatgtcggcatcagtactctgtctaccgcattgtcatctgttactgtacatgtcactgtatatccgcttcggctcacgtttgttatcttcgcattgcttattactggtgcttcatttgcccccggtactgtcgccgtcagctctaccttgcttacttttccttcgctgtcataagcatatatatcagtatgatattttccgctgtcatttttgtggtttgatgtctttacttctattgtatatgtatttccagtcctgttggctgtataccagatcagatcatcctgcccgttgttctcgctccatgtcggcatcagtactctgtctaccgcattgtcatctgttactgtacatgtcactgtatatccgcttcggctcacgtttgttatcttcgcattgcttattaccggtgcttcatttgcccccggtactgtcgccgtcagctctaccttgcttacttttccttcgctgtcataagcatatatatcagtatgatattttccgctgtcatttttgtggtttgatgtctttacttctattgtatatgtatttccgctcctgttggctgtataccagatcagatcatcctgcccgttgttctcgctccatgtcggcatcagtactctgtccaccgcattgtcatctgttactgtacatgtcactgtatatccgcttcggctcacgtttgttatcttcgcattgcttattaccggtgcttcatttttctcatatgaaatatcatttccattatttacaattgttaaatgattagaagatacatatgcataatcactgtcataattatattccgcacttgttgacactgaagtcctattactattcaatactgaatcactttgaatttcatagaattcattttcaggagtcttctttcttactataaaagcataactaggattttttattgttgtatatagaactgttgatgatatattgcttgattgtcgtacattcaaattagtccgtgacgttccagcaacatcttttacaccaatagtataataatttttatcttttccagatatactcgcatccatattttcagcaattgatgcacatttttcaccttcgtatgggtcagaggagtatttgccgaaaattccacttcctttatcaccaaagtacccacccctaaataaacttgtgtatgtcccatttagatatttctttgacatccagtttgatgcaaaatcttcaatacaagcttcgacacttgaatattttttggcatcttctgaagggttagcatctgttgcattcatcccaaataaattatttttattttgagctatagaactcttaccccaacctgattcaagtgcagcaaaactcgctgccattaatgcatttacaccatacttattttgatattttatgaacatgtcaccagtattatttaatttcgatgtacttgagtttgctttattgttaagataagttgttaattcttgagcagtgtagtttgttttacttcgcattggtaggtattgaaaataattataatatggggtacttggattaaccgaatttgttcttacattatttttgtaatccgtaatcatagtattataattttcataaaaatagtgtccatcatagctataatattcttttccttttgtcaaatagcttggtccttttcctacatagttactatttccttgattaccggtagcattaacattattagaaatataatgatataaattacctgatgaatttacttcatagttacttgcataataagttccttgtgttaaaacctctactttacttggatctactaaccctgtaacacctgaaatcataaacttaacttttccattttcataacctaaaaaagcagcatcagcagcacttgcttttgaaatatatcccgcctgtccagtataataatctacaaactccgtagttgttcctgcactactacagttaaaattaaccatattggctgtactcacaactcttaatctaggattatacacttctccagtagtaccatcatagacatccacagttgtgatgtttccattctcatcaacaaatttagtttgaccaataacttccttattaccattttttgtttcaatcgaagaattattttctaattccgtagtggaattactatttagatctatatttttatcattactactttcatcttctactgataaatcatcatgattattaaaagccgcaacatttcccactgtcatacttaatgtaatcaacgatgcagcactaacttttgctatttttttcttcatacacactctcctgactctattaatcagtataagtatacaaaaaatgtgctaatataacaatcattcaatcattaattcacacatttatttataattaaatataattatatacactttcttattttatttgtttaaatatctaaaactatatatctataacgaaccttttccataaacaacacttttaacagttttatacataattgtaaaatctaaccatattgaccaattatgataataatagtcatctaatttacaccgataactaaactccacatcacttcgaccattagcttgccacatccctgtaacaccaggttttaatttaataattgaatcataatattgacccatatcctctttttcacgtggtaagtatggtcttggccctataaaactcatttcaccctttaatacatttacaaattgtggccactcgtctaacgatgttttccttaaaaaatgtccaacaggagtaatccgaggatcatcttttaattttttgttagttaaatactcttcttttattttaggatcctcttccatcattctttcaagctcagcttcggcattaggtatcattgatctaaatttatatattttaatcaactttccatttttcccaatccgctcttgtgaaaacatgatattgtcatggtcaccgctcttaacatatttatatttcacataagccattaatggcagtaaagtcatcacccctgctataccagctaatatatcaataagtctcttaataaacttatctaataatccaatttcatcatttgaagttgcgattagtagctgtccatcaaaatcttgaacttctgaagaaaacgtcattgttccattcacatctggtaaatacttaactgaatcaactttaccatatatatcgctcattaccttatcaattacttgctgatcagcttctggtattgcaataatgatttgttcaatacctaggttttctattgcttcatcaattttatcatattcatatataggactatgcttaataatattttcttgttcaaatctaaataattcatttgttttatttacatcaacatatcccattatattagttaaagcaaatctattattatttgatatttttcctaatcttgctgcctcgtatccggtaccaataactaatgttttcctcgcaaattgttctctaaacgcaattctaagaaatctagatgctaataaactaatcaaaaacattgatatcgccataagcgttaaatgcatttttctttcgtaacctgtagattggggtactaaaactaataaagctatgtaaaaacaaaaacttgatttgacaagctgttgaatttcattccatattaaacaagtatttaatgaataatgtccgtaaataaataaaaataaaaaatatagcgttcctgatcccactattaaatcaatatccatatgaaaatataagcatataaaataatacatcacaacctcaatcataaataacatgattggcattatttttctattcataattccacctcgacattcatagaacaattataccttaatacaactattatttctatcttttatcagtttaaacaactaataagattgtttaaactgataaatattgtataataattatatactttataggaggttgtccatgaaattcttttatacgggattaaataaatttatgtggaatcacccatttatcaaatcttgtactcattttacttcaagattttgtccatacatggttgctattttttatatgctctttttattaaaaatatatttagatcgaccacacaacctattaggtttagcggcagaaccaatagcagtatttgcaattaccgctattttaagaattgtaattgatagaaaacgcccctctgaaaaatatgatttgacaccaattgacggcagtaaaaaaacgggtcattcatttccaagtattcatgttgctatgtcaatatcaattgctttagctgttttacactttggtcctaatatgggattgctattaagtacccttgcaatagctatctcattatgtagacttttatcaggtgttcactacttaactgatattcttgcaagtattgctattgcttttatagttaatttaatttaataactttttaatcacaagataaaaaatattcttgtgatttttattaaataatactgggtgggattaaaggatgcatatagtaatagtaaaatatccaacatgtaattaagaattagaaaacaatatatctattttccaaggttcaaaactaaaattaaaaatagtgatgagtataaaaggtagataattttgatattaaacatttaactaaataatttagaaaaagactcgacttcacttcaaaagtacgagtctttaatatattctttataactcattagatcttctagcaaaagtaaagttaccactcgatactgaagaaatcttaactacatcaccagtttgaggtgcatggatatattgaccattaccaatgtaaataccaacatgacctgacttccataaaatatctcctggtaaagcttgtgatacacttatttgagtaccataactctttaattcacctgttgttcgaggaatactaattcctacttgagcatagcaccacttaacaagcccagaacaatcaaatgtgttgggaccatttcctccccaaacatatgggcatcctaatctcgaatgcgctgcatcaacgatacggtcacgtatcgtaattgtagcatctacaaaagccacaccacttctatcaaatgtggagtttctaggaacaagtttaatttcaattgcttctgattgaatccttccccctatcgtacctgctgtttctccattctttgcccaacctaaccaacccatattggaaacatgcattctataatagatatcaaaaaaatcagacattgttcttgataaactaatttcaattgcctcaataggtttattttgaccttcagttcccgctctttcattgctagagacccaattctgccaacccacatcagaaacatgagttcgatatgttaatccactattaccatcaaaatcacttaatttaattttaacagcttccattctctttttttgattagtagttcctgccatcttaccttcatctgcataactcatccatcccatatcttgcacatgagagctatatgttaatgttggttttgttagtgatggtaatccctctgttgaaatttgacttcctttaataactaatttaatttgaatcgcttctgttcgaagtgcaagtcctatcgatcctgcaatctctccattctttgcccagcctagccaacccctatatggcacgtgtacccgataataaatatcatacatatctttgtactcatttgtaagctccgcttgaaacgcttgtatagctattgctttatctgtagtgcctgcttgagctcctgatgtaacccatgcttgccacccaacatcagctatatgagcacgatatcttaccatacttttatcattttctttaagatttaaaattaatgcctctagtcgcttactttgatttacagttcctgcaatttcattatcatggactgtatctaaccaacctttatcttcaacatgagcttgataatttattgctggtaactccattgcacttaatgaaaggggtgaagtaaaaatgcctaatgtaaaaactagcgtcgtgcatgtaagcattactaccacaaataactttaaaaattttttcataaaacttttctctgtatattagaatctaatctgttatcatcaaatcattaacaaaaaattcaatatacttttcctttcctgatttttatttagaattgttaaagtgaatctatattttaaaccaatccgtacataatttagcttttttcacaacctacttttctattatcaaaatatagttttattaaatatatagaaattttaataaataatttttaaatcaataaaatattatatcaaaaaatagaagagccaaaaacttaactctcctacttcttccatataactaatattaatattttgaatactaatataaccaattaaaatatttaacatacaaaaaacagttaaatactccaatccaattttaaataaagacaatattatctttataaaactatacttgcactcatgttacagatagtttttcgagcattctctcctataatgcttacgaaataatttatggttatacaataagaaagctattgactattaaaattaataagaaaaatgttataattaatatttctggtatatacttttcttcacttaacaacattctaaaaactattaattaattttataaaacttaacgactttagtacagtatatttagagttactcttctaaacagaattttttacacattatatttactaaactttagtaattacagcacttactaaatattctctatcattgacttttatttgagtatcatcagtaaagccaaaatcatttgatccaatttcaattttttttcatcatcattaagaaacacagtcccataatatgaattatcaccacatagactaatattatatattccagcctctaaatccactccaaccttaaatacaccattattttaaagatttaatgttgatcgctcatcaacaaataacactgtttcattagattgatatgtcaagcccatatcttcgtaattttcataaaaaataaatacttgacctactttttatttctagcaaatgcatcaacacttgcctcaagattttctccatattctgttgcatacccggtagcttctaaaacttactttatttctgaattagtttttaattctgagctgtttgagccactcgaattatctgatttactactgcccccaaccattccaatacataaaaatagtaccaatacaattgaacttattgtaatcttcagataaatacccatatctttgaatcatggtaaatagaatatattatcaagatttcatactataaagcatatctatctaaaatattctttaaataattttattagactcttttctagactttctgaaacatataataaaaatcaacgcaatacttaattaaacttataaatattctcatctaaaaaagttgaactcttttgaacttcagcctcaatataagcctgaccatacttttcaatcgctgtaggtaaactactaaaaagatttgtacctaaagctaacttatttccatctactttaaatcccatagctgctaacgtagttggaaacatatctaaatgactgaactgtctgttttttatattattactcgatactttagaattaataaaacagttatatgtcgttctaacataatcagcaggaatatctttagtatatttaaccgccatagtattatgatcaccaactaaaacaattgttgtatttgcaaaccaggactgttccttacaccatgagataaaattatttacttgttttgattgacaagcataaatattctcatatctatttgaataggtattcggacaaagtgaacatttaattccatcggttgtatggcaatctattgttgccattgtaaaattaaatttttgaccactattgactaagttagttatctcctccttagcaattctaaataagccctgatcatttattccccactcgcacacttcacctcgttgcactcgtccatcattcttaagggctttataatctacgatcttatagtttccatgttgttcgaacagcttatcagtccccgcgaaagtcgcattacctccaatacaaaattcctgaatataaccattttccgcaagaatatcaccaatcatttttgctcccggcataaatttagcataattactcatatcattagctacttctgattttaatggcaagcctgatgactgccctaccattgaagctatcgtccaagtagttccagtaaaccccaaagcccctccagctttgtcagtatttgaaaaactaatattctcattggctaattgagtcagctcaggtaaacaattaatttctttgataccgccattaacaacatccatgaacgtattttcataagactctaaatatatatatattaaattattaggattctcaccagaaactgcaacactcgttggatcagcataaataagttctggatctccgtccgaaacctctttctttacagcaatctttttcggctcatatatttccgttttttgattacttttgcgcaaatagtcaaataccccaaaattactttctgccatagataacgcacctgccaataaaacaactcctaaaacccatagatgacgattaatcacatataaaaatcttggtttcacaaatctatttgcccaatattttcttatcaaatagtaagaaattaaaacaattaccattattaccaaagaaaaaacaagtgattctaaaatccagctaataataataccatgatcagtacttgttgtcggagctaatacagtaaacaacaactgatccatatctacttttccaaaagtacgattacaccacaataccgaagtacaaatcattaacgataaaaataaaaaaatactaaatataattattgatacagctctatgccttttactcattactatcaccaaatttaattttaacataatctttaacaatttctaacaaatttctaacacaataatatattcgtttctaaattagattaaaaatttatttttctttaaaaaaacaacacttcaccttataatataactatggaaaaactatattcaactggtgaatttgcgaaaatggcaggtgtcaccttaagaacaatcagatattatgataaaatcggtcttttaaaaccaacaaaaattcttgataacggatatcgccgctattgcaatcgtgatttaattacccttcaaaagatcctctcactaaaagaattaggattctcacttgaagaaatttatcctcttattcaagataataaccaggataactttaaagagtcgattaaactgcaaaccaatctaattgatcagaaaatcaaacatttaaccaatctaaaagattctttaaaagcaacagagcgtctaatcaataaaaaaaatatcgcctgggacaaaattattgaactgatccgcttatcaacaattgatgataatcttgtcacgcaatatatgaatgctaaaaatcttgatacacgaatcaaactgcatgacaaattttcaataaaccagcaaggctggtttccctggatttttgaacaaattgatttttccaccgtgtatcgtctattagagctcggctgtggaaatggtaaattatgggagaacaatacatataatcttcgtaatcgagaaatcttcttatcagataattctgagggaatgatagatgaaattcgtcaaaaacttggaaatgattataattatattgttgcagactgccaaagtattccttttaaaaataactactttgatacaattgttgctaatcacatgcttttttatttaaaggatttaaaacaaggtttaactgaaataactcgtgtcttaaagaataatggtactttttattgcacgacctacagtaaatatcatatgcaggaaattagcgaacttgctcaaaactttgactcacgtatctctttatctgatgatcctcttcctgaacgtttcggtcttgaaaatggtaaagatattttaaaaagctattttaattatgtggaattaaaaaaatatgaagattatttgttaataactgaagcccaaccacttatcgattatattcttagttgtcatggtaatcaaaacgaataccttggtaatcgactaaaagaatttaaaatatatatcgaagatttaatcaaagaatcccaggggattaagatcaccaaggactctggtttatttatttgtacgaagtaaagcgactcttttaggagtcgctttactttttaaattggttcaggagcctctagataccgctccgcataacatgtacagatcattcccgtaatggctgctaataaatatggatgactggcatagtcattaatactttcatagcgaatatagtaatctacatagggaatttcaatatccgaattacaagtaattaaatatattttaggtttgtcattagtatttctaaataatgtctttctttcaaaagctcgtttaaaataagtaccggattctgataaaataataatcaaattactactatcagcattattgatatattcaatttgatcactatatttcattgatgtatgaataaatttatggcatgtttgaagatcatattgtaaattttgggcaacactttgtgattgcatatatccaaaggctgcaacatttgaataattcgcaatatcagttaccaatttataaatatctttttcgttaattgttctctttaataattgtaaattttctataaccccttcaacaaaggattgaccaggaacctctttttgataactttgataatagaatttatttttggcatactggtgagctggctggtactttgcaatttgactttttaactcattataatctcgtaagccaatatcacggcaaaacctagaaatactagaattagacacatagcactctttcgctaattcggttatggagatatcctccagagcccgcatgttctctaaaatatatttagcaattcgataattattagaattaattaattcgctattgatcgttgataacaagataatcgttaaattatacataccagttccacccttcataaaatctattaataattcaatagtatatcatgaacagttaaaatgtctaattttattttctaattactactgttcttgctagtttatcatgaaaagattgtgataaaggattaaaatacgcataaataattgaagcgagggttattgcatacgctccatatttaagaatcggaataatctcggctgtaatcaataagccaattaatttacggatatacgtggctgaaacgacaatcccaccttctattactactgcaccaatgatttctcttaaaaacattgtttttgtatccactttttgtccatcagttttaacaacttgtagtttacaaattttctttcctaaagtttgacctttccatatatatgtcggaacagcaaaataataacaaatcccaacaactacaacaaacagaccatagatcattcctattttatagccatatgtttctagttgaaaagaatatggttgaatatagtccttacccctaagaaaaaaagttacaggaatagcgacaatcatattactactgtaccagtcaatgaccattgctaaaaaacgctgaaatcgcaacttagcaatatcgtagccttttatctctatttttcttttattatctctttttttactcatttttcttctccaataaatttttaaaataaaaagagatttaaaatctctttttggtgtgtaagtttatctttatccttgattgtatcaacttttaataaattagctattttcttcagctaatttctgtttttccattaatttaaagaatggataataaagtagcatatccaaaataattaagataataaccatgattcccgctttgatatccatacagcccaaggctgcgccaatcggtgccggagttgtccatggagtctcaactacgccctttccaacaatatttaaagccatacaagtataagcaataattgtattaattaccggtacaaaaataaatggtatcatcattaacggattcaagaccattggtaacccgaagatgattggctcattgatattaaaaattgctggtccgattgataatttacctaatgtctttaactctactgattttgagcgtaacaagagaatacataaacctaatgttgcacctccgccaccaagtgtaattacataagaccaaaatggttgagtaaagaaattgacaattggctcaccagctgaaaaagcagtgatatttgccattaaatacatttgcataaacggcagtctgattggctgcgtaatacttgccccatgtaaaccaaagaaccagaaagtttgagcaataattgtaattaaacaaattccaagtaatgaatctaatcctgaaattgctggtgctaaaatcgtcatgatcaaactaggtaataattcaccactaatattttgaataatcaatgataagccatagaagactcccatacaaacaaatagtggtaaaattgaatcaaatgatgaagcgattgctggaggaactccctcaggcatcttaaaacgaatatttttcttcaacatcaccctcattatttcaacacagccgatagaaacaataatagcagtaaaaatacctttagcatctaggtaggtcgtaggaataaaactagctgcctgtgctaatagatcattagtattggccccctcactaattgcactagtcaataccgcagttgttgttggtgcacaaatcaataaaaatactgtggttgaaacaatcgctgcatttaatcctgacatttcatatcttttagccaaatgatatgcgatcgcgatagcaacaaatagccccattaatgccattgtcatattgtacggcagtcgcaaagccgttgcattggcctgagcccaattataccagccaattaatagatcactaattactccccaatccggtaaactctttggcgtaaatggtggagttgaaataattaaacaaaaaccacctaaaatcgataatggaatcgccactaccataccatcacgaattgctgccaaatgacgctggttcccaagtttattagcaattggaactaaagtcttattggcaatctcattgaatttttcaataaaattcatattttaattcctcccttcttttaacctccccatgattatataaactcaaccagtctataaacaattattttgcataattgcgaaataatttccaatatttggaaatcactaattattttagttgaatttatgataaaatgaaaaaatagctaaaaaaagttattttaaaaaatataaatattattaattattttaccaaaattaccttgacctaatatctttattgccttagaatagcctttgtgtaagctttacttctttatccaagatgtttcataaaatatgaaaatcaaggagaaagattatgaaattaattattgaagattcaaaagaaaaaatgagtgaaagtgcgatgcaaattttactcggaacaatgatgcaagataagcgtgtaaatatttcactaaccgctggtcgttcacccgaattattatataaaatgatgattccatatgttaaagatcaagcaaaattcgctgatgtgcaatattatttattcgatgaagccccatatattggaaaaacagctaaagaagatggtgaaaactggaaagaaatgcaaaaagtgttttttgaaccagctaatattcctgccgatcgagttcatatcactactatggacaattgggaaacctttgatgaacagattcgtaatgccggagaaatcgatgcaatgctgattgggttaggatttgatggtcacttttgtagtaactgtcctcgctgtacaccaatggacagctatacttatgcattagaacgcaaaattaaaaatgcggttaatcccgcttatgctgataaaccccaacaaccggtaactttaacaatgggtccaaagagtttgatgcgagtaaaacacctagtaatgattgtcacaggtaaagaaaaagcagaaattttaaagcaaatgcttgattcaccaatcactgacgaattaccagctaccattttaaaactgcatcctaactttacggttatttgtgatcaagatgctgcttcattactagatttaaataactataaaagattataacaaaacggcctattgtagtgtcccgcctaaagttagactgactttaggcgagcgctgcatattagccgttttatttattttcatatttttttgcacttgagaagccttttcccctaacctcatttaccttattgataatcataaaggcatcaggatcgatgtcataaacataattatttaactgggtcaactctcgattatttacaactgttaaaactactgggtactgattatgcttaaaacccgtctcactatgaatcagtgtagttccccgatcaagaacactaataatcttttcatttatctcattaaatttagcgctaactattttgacttgcatctgtgattttccaataaccaatactttatctaagacaacagtatagatcagcactagcaagattccataaaaaaccatttctcgattacgaatgaccatttgtcctagtaaaataataaaatcaaaaccatacatacttactgaaataggaatacctaattttttatttaggatcaatggcggtatatccattcctccagtactagctccacaacgaattactaacccgattgctgtaccaatcattaatcccgctaaaataacgcataataatgtatctttactcatcatttcatttttaaaaacaccttgaagaatccctaaaatgaatggatagtaaaaagaactgatcaaagtcgttaaagcaaactttttccctaatactttccacccaattaaaaacatactgacattaaaaattgaaacaaagacagttattgaaaatccagtcgtcgcatttactaacaacgccatccctgttgttccacctgtaattaaattattaggtaaaataaacatcgttactcctaaagcataaattgtattacctaataatattccgattatatttctgatatctttcattttctcactctttcatcattactttcaactttatctattttaaatcataattgttttttatacaatacaattactaattaattcttttagacatctttttagtactaaaaactttaatatcattatacaataacacttgacccttacgttacgtaatggtttaagattatgatgaaataaaggaggctttttaatatgaaaggtattgtattagctggaggatctggaacaagattatatcctctaactcaagtaacaagtaaacaattattaccaatttatgacaaaccaatgatttattatccattaagtattttgatggaagctggaatcaaagatatcctaatcatctcgacacctgatgatactcctcgttttgaagaactattaggtgacggcagccaatttgggatttcacttcaatacaaagtacaaccctctcctgatggattagctcaggcatttattcttggtgaagaatttattgatggtgaaggatgtgcaatggtcttaggggataatattttccatggtcatggcttaggtaaacgtttaagagaagctgctaataagtttagtggagcaaccgtatttggatattatgttgatgatcctgagagatttggggttgttgaatttgatgaaaatggtaaagctgtttcactagaagaaaaaccagctaatcctaaatctaattatgctgttacagggctatatttctatgataaaaatgttgttgaattcgctaaaagtattaaaccaagtgcccgtggcgaattagaaattactgatttaaataaaatctatctagataatggtactttagatgtaactttattaggacaaggatttacctggttagatacaggaactcatgaaagtttagtcgatgcaactaactttgttaaaactgtagaaactcatcaaaaccggaagattgcatgtcttgaagaaatcgcttataataacgggtggatttccaaagaccagcttaatacatcatatgagttgtataagaaaaaccaatatggtaaatatttaaaagatgtattagacggtaaatttatagatcaataagaggtagacaaatgaaaaaaattgaaactaaaatccctggtgtggttatcattgagccagatattcatggtgatcaccgcggttatttcatggaaacatattcaacaagtaattttcatgaattaggaattgataatgtctttgttcaagacaacatgtcttttacagcaaaaaaagggactttaagaggcttgcatttccaaaatgatccaatggcccaagctaaattagttagctgtactaaaggaactgttattgatgtcgctgttgatattcgtaaaggttctccaacttataaacaatgggttgcagtagagttgagtgaagaaaataagaagatgttctttattcctcgaggatttgctcatggtttcttaacattaactgataatgttgaatttagatacaaagtagataatttatactctaaagaacatgatcggggaattcgttacgatgatccttcggtcaatgttgattggggcggattattaaatggaattgaaccaatcttatcagataaagataaaaatggtcctacattagatgaaagtgattgtaattttaaattcgaaggagataaataaatgaaaattttagtaacaggtggagcaggtttcatcggtggaaactttgttcactatatggttgaaacttatccagaagatatgatcgttaacttagatttattaacttatgctggaaacttagagacttgtaaaccagttgaaggtaaaccgaattataaatttgttaaaggtgatattgctgaccgtgaattcatctttaagttatttgaagaagaaaaatttgatgttgttgttaacttcgcagcagaatcacatgttgatagaagtattactgatcctgaaatcttcgttaaaacaaatgttatgggaacaactactttattagatgcagctaaagaatttggagtaaaaagatatcatcaagtatctactgatgaagtatatggtgacctacctttagatcgacctgatttgttctttactgaaacaacaccattacacacatctagtccttatagttcatcaaaagcttctgcagatttatttgttttagcttatcatcgtacttttggattaccagtaactatttctagatgttcaaataactatggtccatatcatttccctgaaaagttaattccattaatgatttcaagagctttagctgatgaagaattaccagtatatggtaaaggtgataatgttcgtgactggttacatgtatacgatcactgtgttgcaattgacttaattattagaaaaggtcgtgttggtgaagtttataatgttggtggtcataatgaaagaactaatttagaagttgttcaaactattttaaaagctttaaataaacctgaatctttaatcaaatatgttgaagatcgtaaggggcatgatcgtcgttatgctattgatccaactaaattagaaacagaacttggatggaaaccaaaatataactttgatactggtatccaacaaaccattcaatggtatttagataataaagaatggtggcaaaatattctttctggtgaatatcaaaactattttgagaaaatgtacgctggaaaagtaaaataattgttatttaaattaaaaattgttgaacataaatgagttcaacaattttttttattatcaaattaattaaaatttgaagatttttggttcttctgtaaaagaacagatttttgcagttacattacgaagataaaatacttctgtatttccatctccaggctgatacattttttgcaatgatggataggctgctaacatatgtttttgtgcatcaatattattatcaagataagcagttgcttcaattctaatccattttccatcatccatagcacaaatctctatttgaggattctctttaatttgtcgcgaaacagctttaactttaccagtttggatatacaatctattattatacaaatcaattgtcccaaatggcctaacccgcggtttataaccctcaacagtagctaaataataagttccacatttcttcaagaattcataaacttcattcataccagctcctccttataatatatattttactcccctcaactcattagtacaatctaatcattataaacttagttaaatcattatattagttataattttattctttaatctctcttatcagcatttataataaataatttaaaataattaaaattaaaaaagcattcctttagtttaactaagaaaatgctttttaataattttaataatgaataaaaactggatcattcattctaatcagctcatataattttttggcatcctcttcttgaagattcaaacatccatgtgatccttttactttatacagatctggagtccaatttgcccagtcgcttcgatccaaagcatgatatccagttcctgtccacataattctaatccaatatttaaccggagtctcgtaatcttcgccaactaaaactttctctggttttttctctttgatataccatacccctgtacgtgtgatacgatcgtttttctcagttggtaatccacttacacaaatacaagaataagctaattgaccatcacgatacacgtatactctttgttcagttaaatcaatttcactataattttgagtatcccaatcattttcaaagttttcataatctttttgatatgccttattagaataagttggttctaattccgttgttaaagctttttgattctttttactttgctcactgaggtaggcctcaattaatttactgtccgttttttcagtaatcgctgcttctacttgtttaacgatcttttcataatcaaggcgccagccatagtcaccacctgaaatctgaatcacgtttccattatgagtcgtaaaattacgtttctttccaactgtcttatagcgcaaacaaaattcttcaatccactcgctcattgcttctttatcaaggacaacttcacctttatcattacagcttaaccagtttttaatatcatctggtgtcatcgtctcaactttgccttctcccatatcccagttaatccaatttaatagataattattatacgtattcaacatctcttctaaatgcttatcactaatatcactaactggctgttgataaacttctgcatatttatcttgatcagttaaatcaatctttgtagttaatttacttattgacgttgtaattaagttactaaatttttcgagatttagttcatttccaattgttgctttaaccatttttccactcttcgttgtttcatcgtattcaatatgagcatttgttgactgcacaatttgatattcttcattcccattgataagcactgaaccattaactatttcacttaatttattttgatcataagatatttttaaatcaatatcatggttgtaaccactaaaaatcccaaaaatactacgttgactgcgatgatttttatagtcactttctagatttttttcaaaatctgcacttaaattaatatctttccctgcaatcgtaagcttttgatttccctctgcccctatttccaaagcataactttcaatctggttctttaatacatttttactttcttcataagtcatgcttgatacatcgattccattaatagatgtattaggataccacttatcacgataataaaatgaaaaaatagcaaagacaacaataactcctataattactccaccagtaattttaacactcttttttaatttttttatcttcttaataaacgccaatctacttctctccttacaacaacaaaccttaaattttatctcattatagcacaaataatatcggtttcaatcaattcgcttaattaacaaaaaaatcaacaatcttaaataaatttaacaaatttaacataaaaagccgactataatcgtcggctaacttaatccttttacatcagcttcagtaagttttttaccagcttcaattttatcaattactttacgaatattttgaattgattttttataagggattgtaatatatgttttcttccctttttgcgaatatgtatcatatgaaatagccccatcaccagttacttgaacattgaatatttcccaattggccatatcatctaactgcatattaactaatgacttgatatcatcacttgacatatcagtttcaaaacttccctcaacagctgctaaaatattgctatagttagtaataattttcggtgacattgcttttttcaacattgcttttaataaccgctgctgatttttaccacgatcaaagtctcccgatggtagagcataacgttcccgaacaaaacataatgcttgatcaccatttaattcattgacacctttttttatcttataattaccatgtaatgttgtaaattcatacggtgaatctacttccactccccccaaggcatcaataatgtttgtaattccactaaaattagtttttgcataataattgacttttagatctaaaaagtcttctagtgtctgaattgtctcattaattccatacattgctgaatgggtaattttatccatcttaccatttttatgcagattgacttgagtatctctaggaacactaaccatcaatacttgtttttcaaatggattgacacaaacaacaagatttacatccgcacgagagatagtgttaactgaaccatatgtatcaataccagttatatagacaataaaaggattttcagtaacatctgtctttgttgttactgcttctaatttttcttgaacttccattttataaaccactttagtttcatcttcaaaactttcgtgattagtttccaacacacctaaatatgactgatcagcaacaatacaatctacttcacctttatacagagcatctgctaaatcagcataatcactataatttttcttttcaggttctttaccgattttttcttgtacttgtgctaaagcatcggtaatactagatacactagttttattttctactccgattgtttttcctttcaaatcttcaactttattaatttttccttgcttcattgcatatactgcaataactctagtttgtgtaaatgcacttgtaatattacttaaaaaactattaccctgtgaagcatacacgcttcctacgatcaatagagcagataaagcaacacttacgaacttactaataaaaattctaaagccttttcctgttcttctttttcttcgtgctccggatgtaatccaaatcatttcaagcaataataatgctattaaaacaattattaaaattgcataatacctagttggtaacattttcaatacataaatatatcctaagaatacggctgaagcaattaactgtatcgttaaaataattcctttagatgtaagtttagaaaacattccttttttctttttcttctttgccattctctcacctcaccgaacaccttttataatatcatattgatttgtcgtagcataggttattttgttgttaaatagaaagagcttcataatgaagctctttagtttcctagcccttttaaatcctcttcagaaatagttccaccttgttctaccgtatcaatgatcttcttaatttttttaacttgtttttgataaggtttcattacatagacctctgttccatacattgatgcagttttcgaagttttataaccttcaccttctacttgaacattataaacagtccaatccgacatatcgtttaactgcatattcaataacgacttaatttctttacttgacatatcagtttcaaaacttccttcaatcgcagtcaaaatattattaaaattagtgattatctttggtgacattgctttttctaacattgcttttaataatttttgttgatttttaccacggtcaaaatctccatttggtaaagaatatctttcccgaacaaagcataatgctttatccccatccatttggttttcgcctttaacaatgttgtaattaccatgtaatgttgtgaatttataatcagaatcgattgttaccccaccaagagcatctacaatatttgtcattccactaaaattagttctcgcaaaataattaatttcaacatctaagaaatcttcaatcgtactaattgtttcacttgttccatagattccggtatgagttaatttatccattttaccattcttatgcaattgaatttcacaatcacgcggaatactggtcatcaaaatttgttttgttttaggattaacagtaacaatcaagtttacatcacttcgagctacggtactaacactaccatatgtatcaattccagtaacataaattgtaaatgggttttctgttacatttgtttgtttagttgtaacacttaacttagattcatattcatatgatttaataatttttgtttcgtcatcaaaactatcatgatttgcttccaacatcgacttatattcttgtccaacaataatagcatctacttcacctttatacagagcatcggccaatccgctatagtcatcatatttaaccatatcttcttgttccccaagatcattttccatatcagcaattgctttagtaatcgtcgttgtatcatgttgataagatacaccaaatttctttccatcaagatcacttaatttagttgcactattatttttcattgtaatcactgaaactaaatatttttgtgttgttgctttagtaacggtattaaaaaaatcatttcccctaacaacataacttgatgcgaacattaataaaatactcattaataagctaataatttttgtaacgattgaacgcttgctttttaaaccttgattaattttcttttgcccgctcctcatgataaagaagaaaattataattaataaacctaatgcccctgtcgctggaatcaagtattttaatggtactagatctaattgaaagattaaatatgtaaacaatgcggttgcgaataactgcactgccaaaatcaaatacttagaagtaataaatttaataaacttattgtctttcatataagcctcctatattcgcacttttttaccgttaaataatatcataatctgttttataatacaaatttatgtcgaaataaatagaaattttaagaattttgtaagaaatattaatcattcatctatgtttattaataaacatgttatattatggtctttatgtgataattttagccacttttatcataatccttctttctcatgaataatccatgttatactaaaaataggaggaatccaaaaatgaaaaagatattactgacgatattatcactatttttattaaccgggtgttttagttttcgtgaaaagtctaattctcgaccagcaataactattgatactgactacttaagcggcgatgcgagttatttatactattatcagtctttatcatctaaagaaaaagaaatttatgaaaatatttataattgcattcttgataatgcaaaaaaggtcacaatcagcagtaatgattatgaattagttcaaaaaataaatgattatgttttatatgatcatcccgaaatctattatctagattattttgagctacaaaatcaagttgatatatgtaattatattcccagttattcatattctaaaagtgaacgtgacactttaacagctcaattagaatctgtccgtgatgaattagtaaattcgatttcaagtgaaagtagtgattatgataaattaaaaaaaatttatcaatttgtaattgagaagtgtcgatatgttgataatgctaaagataatcaatatattactagctcgttaatttatggtgaaacagtttgcagcggctatgtaaaggctattcagtatcttgctgaagcagttgggataaaaagcgcctatatcgtgggtaaagaaattggtgctagtgacgatgaagcttatcatgcctggaatttaatttatctagatgatgactattactatcttgatgctacttggggtgattatgatagcgaaggcaatatttttgcaatgatgaactattttatgtttgattctgatgatatgttgaaattatatgaacctcttgatcaatatgaaataacgaaacaaggaaattatacgtatttcaaatatgagaatctttataacgaaaattacaataaagcagcattaaataaaatggtaaaacagtataaacatgataatattgcctggatggaatttaaatttagtgacagttgttatcaggaagcaaaaaaaagattgattgatcaagaggaaatgtttgaccttttcaatccctatacaagtaagcaatatactgttcaatatttttattatgataatttaaatgttttaatttttaatcaaaaaatcgaataatcagccgttcgacacgactcgttattatccttgaaaattcgagaattcttcacgaattttcacgaaaactttcttgttatagggaacttaattccttactttactaaatccctaattatctataaataaacccttttctcttttatactgtataaatataataaattttgtcactaaaacgaaaggggaatatagagatgacagacgttaaaaagtatacagtatacattttagaagaaaacaaggatttattgaataatattaaggacagtttaattgcgacaaataactttaccgttattggtactagcgataatgcaacaagctgtttaaactatttatctaataataattgtgatttattaattattgatttaatgcttaccaacattgatggaatcggtgttctaaataaacttaaggaagtaaatagtcgtgcctataataaagtagtttgtattactagctttactaatccattaatttgtgaaacattagaaaaattaaatgtaagttattgttttaaacaaccattcgatatcaattattttgcgacaaccttaaattctgtaatgaaagttacattagaagatattaaaggtatgtcacaaaacgaatctgaaaaatatcaaaaaattaagttagaaaatgaaattacagatatccttcatgaagttgggattccagcccacatcaaaggatatatgtacctaagaactgcaattctatctacttactataatatcgaattattaggtcaagtaactaaagtcctttatccagatattgcccgccaatacagtactaccgcttcaagagtagaacgtgccattcgtcatgctattgaagttgcttggaaccgcggtaatactgatgcaattgatgatatctttggttatacagtcagtgcaactaaatcaaaacctaccaattctgaatttattgcaatgattgctgataaacttcgtctagaacatcaaacaaaagcggcaagccgtcatagttacttataagagcgtaagctctttttttctacctaattttagaaaaactaatctttttcttatatcaatcatggagatctccataactgacataaaaagaggaattaaatcctcggatcgttaacttcctttatactttgataataactcatctacaattgttgaaataaattcagaattacatgttttacgttttgcccgaaatccaaatagctgctctagctcatcttgacaaccactttcccaagtacattttaaaacatgacgaatcgactgttcaactcgtgatgccgttgttccataagttctagcaatacgcggatataattctttagtaatttctcctaaaagattaatatttccacaaactaaaacaattgctgtaactagataattatagccttttaaatgtcgtggcattcccactttcataaacgtatcatgaatttccttttttagaactgtttgatgataatcgtcaatacctaaattatgttttaatctaatttttaagatacgatcaatgatttccataaaatagtttaaatcaaccggtttctttaaacagtaatctactgctaagccttctaacatttcaaatactagtgagttagtaaaatcactaatacaaataacatgttttaaggcttttggattgttagatcttatattcccaatcactccagcaccatctatattagtcaaaattaaatcaattacaagtaaatcacatgtatgcgtagctaaatagtcttcacatataccaccatcattaaaagttgcaataatttcataatgatcattacttctaatcttattgaccagtttctctttcaacaaatgattttctgttaaaatcacaatacctgccttattattcatttttaaataactctgtgcctaatacacttctcctcactttttcctttatcccatgtctaaaaacctatttttaagcgcactaaaacatcatatccgagcctgtttcataatttgccaagaacttgtgatttaatattaatttcatgttcaaagaactcatttatacactcccccctaacttatcccgagtgctagtataacaaatttttccaatttcgaacataaaacttatgtgtatatagcaaattagctaaaccaaatggttcagtaggcgtgacgaggatgaatttgagaaacatttcatctgtaaaaattgtacttgatatttttcaaagaaatatctctgaatctctctttctttactttttagggtaaatccagatttttttagataatttacccacttccgttcataatttttaataacataaatagcatttggacgatcaatagttggataactacttaaaaattcttctaaccggtgattatagtaagatcttagcatctcaatttgtgtagtcagcaaaagcattgatgaaggtaccatgcactcaacaaaaactgcatgtgtttttccacagtgtttacacatcacgcgctggattcgaatacaaattttattagttgcagttttataaaatcttggataacatccaatcttaacaaaactccctttggccccacaactacactccaggcttttaaaatcaacatgatctaacacttgatcatatatttcttgagtaaattcgttaataaaatactcggcactattagcaactgttatcattttctttatccccttaaattatccctttctttaaaatatcctattttcatcagaattgcaattatttagatagtcaaagtttttttaattaagttaattttaaggagctaaatacacaaatataaaagacagtcagtttctttttcttttcttgacaatcttaataaacttaaaaagggataattttatcccttataattttaagcaaacaactgtagtatccatttgaaaaacgctggaaatacagaataatcaaaatcatttgaccatctagcaaagtccgctactgttgttgataaaacgcctaccgttaacgcttgtccaaatgacaataacagtccagcaacgactccagctaaaatagccccacgccagcctcctgtagagtttccaaaaacacctgctggtccacctccaaaaaaggtagtaataaccggtggtgtcagagcataccagccaattgcaccaaagataatcgtacacaatataactgtacctaaacaacttaaaaaacctagcataactgcagttggagcaaagttaaaaacgacaggacagtctaatgctggtactgcattaggtacaattttttcagaaatacctttaaacgcttctgtgatctctgaaaccatcattgaaacaccattcaatacaattgtaatccccactccaaattgaacgccagaaacaatcgcatataaaattgcgggctgtccattacttaaattcgcttcgacataatcaaaaccagccaagcatactgccacgatatataggattgtcataactaaagcggtagaaactgtaatgtcttttaaaaagtttaatttaggattaatattaatgttttcagacgattcatttttatgttttttaaataaatttccaactaatgaacccgtaataactccgaatgttgtggtgtgaccataggcaaaatcatcactgccggtaacctttctcaagaaaggctgggccaatgctggagctaaagtacagtagattcctgttagtagaccaccaataataatgactaacgtattatttggattagcaaacacttctacagctacagctaaataaacaaagatcaaataatatgtttgatgtgctgttaaaaacacgtacttaaatggtgtaaatctagctaaaattagatttataaaaaaaccaataaccataataattgcaatcgtcgatgcccactgttcagtaaatgcatttgttcccattccagttgcaactgtttcaatccccataattttttccagcagcgtagctatcggcgtaactacgcctgcgattgtgcttgttcctacacttagaattaaataaccgattcccgttttgactgatccagaaataattttatctattgattttttttgtaaaataagaccaatcatcgcaacaatacttaagaaaataaacggctgattaaacacataattttgaaaaatatctacaataactttaaatactgacataatctccctcctctacaataaattctttttttctaataatttttttattttttcctctaattcattcatatccattagattattgattacaataacatcctcataacaagaacgtaattcatcagcaaacgattcaaaagtaaatactgcatcgcacattagtcctttagacattgataatcctttattctcaactgttacctctaatggtaaagcaaattttttaaaagttttatcaatattcattcttaacaaagtgcttgttccgactccggcaccacataccgtgataactttaaaacttttcatttttcatccctcttttgcatcatgtaatattgtttttactattttagctggctcacttatggatgttccgataacaactgcaaaagctcctgcctctatacatttcttcatcttactaccgtcattaattcttccttcggcaatgactcttgatactccggctgtttttagctctttaataatttcataatctggatctggtgatggcactgttccaaatataattggatttttagaatatggcgtgtatcctgataaagtagtacctactgcatcaactcccgctttagatgctctgattccctcttccactgtagaaatatctgcaataacaaataactctggatatttattttttattttattaacaaattcttctaatgataaatcatcataacgttctctttgagtgccatctatggctataccatcaacgccagctgcaactagctgatcgacttcatccattgttggtgtaattctaaaactagaatgaagcggatcatctcctttatagatttttttaataccaataagcggaacatctacaacttctgcaattgcctttacatgttctaaatttgttcttatcgccttagctcctccagcaacacaactttgagccaggcattgaattgcaatagaattgtccatatagggatttattgctgaatcagcataacaagaaactatcagtccccctttaatagcatcaatatttttattatcctttaaaatatcttgataagaacgggcattaaatattttatgtaaatattttctatccattagacatagtgccacttcttgaaacagctttaaatgctcctcatcacttttagctgcaagcgctaacaatactcgaactggatcattaacagagtgtccaaacttcactccatttttaaaagttactaagctaatactattttgatacacatgaccatttggtcttgcgtgagccaaggcaacccctggcatgactacaatataggggccatttttttcaataatattcaccatatcatttatatactggtgatcaatatagccatttttctctaatagataaccagcatagacaattgcttctttccaatcatggcactctttataaaaatccacacaattctcttttatatatttaatcatatttacttacctcattaatctggtctaaaacatagtctagttcaaaataacgttctatcccattatttcttatattctctaaaaatttgataaaattatttaatgctttcatgtgcgtataattatctttagccgctaaacataaaataatatgcactggatcatatttatcatgattaaatttgacaccatttttaataattaacagactcattgatgtttgattaaccccataatcaatttctccatgaataagggctattccttcatcaataaccatatatgaccctgattttttcaccgtatctatcattgatttaatataacattctgcaatatcttgactcttaactagcatttgtccggcacagcagactgcagtctcccaatgatcgaccgtatcacatagtagaactttatcagcagttaaatattcatttaataatggctgcagtttgattcctgcatcaattcctaaatctttaaaatattcactgaaatcatcgaaaagctgctgatagtttacaatctcgcagtttctcttaacaatacttaaaattccatccataaaagtatcactttcttgaatattttgatgaacaattttttccatagcattttcaatcaatcgataatcactctcttttaaaattacattgactttaacaaccaaacactgcattatttgtagatcaatacttgaaataataaaatcgatattactgagatctatatttaaaatccgttcttcagttactgttttcttcacaataatatttttaaatctcgagcagatcatctccttcattaaagaagccgtcccaaaaccatgaacacaaacaattacaacattatacacatctttaaaacgattttttctctctaaagcggcacaaaaatgaagcgttaaaaaagctatatcatcctctttaattccttttaattccttatagcctaattcatcaattgtttctaataatgctataaaaacttcatgataatttttcttaataactgtcaaactcggattaacaaccggtacttgattttgcagtttaaatactgtaggacctaaatggagggttaaagaattgatcaattcctcatctcgactaaaatttacattaagtttttctcctactttaaaggctaaagtagttgctatcatttgtatattagcccaatcatagataacatatcgctttaaagtcgtatatctagcactatttaataagatcgtaataatagcaacttctgattgtgacatcttaatatttaatgcctgcattatttgtgaacaaataaattgagcatcatgatatccttctgtttttgaaatctcaatcaaataatcttgatgtaggatgatatcataccctaattctattcttgtcaaagaaacagctaaatggatacaaatatctttatatgataaataggttaatttcttttcactatgactttcaaaatcattcataactttaataatgattttccagtatttatcgaagaccattcgataaatattcttttcaataaaagttattggtgtatattgaaagtgcataaatttattaaaatcaatattcttttcaataactctaaagaaacatgagcgtatgtctctttcgtcaccctctatataactgccttttcctgtttttacattaatagaaaaatcatatccctcatattcttgtcttatcgaaagaatatctttatcaatactacttttactaacattcatttcatcagcaaaatactgacttgtgagtggttcactgcaacaccacattgaaactaaaatatagcactttctttcaaacggacttatcgcatatacataattatccaaattcgaaatttctttcatcagtatctctttttcttgatgagtaatattaaactgaatctttccatttcttatcattatattttttttaacatttattgtttctaaaaaatcattaatatcatcaataacatatctaatcattcgaatagagatctcaaaatcatgtgctaaatcttctacttgatagttttttccgccgcacagcttcttcaatatttccacacttctagtattcataagatatcctcatatgattcaataagagaatcatacgcctcctctctactcacttcatataatgaatgcgatttttatattggtttaagatattttgattatattcgtcacctccatcaatattagcactatgaaaaatcggtggttcgaagtcgtcattaactagattttctactacttgaataatcacactatttaaaataaaagctccggctattgtagaggttggggcaaccttttggtctagaccatcaatagtaatactggaatcctcaaaatctccacaattatcaataacaatatctgcaatatctaacaatttctttcctgtttcatgtcgcgaaactacagcttgactatattctatatttgtaacagcaatcacgatcacacccattgccttagcccgtaatgccatatcaattgcaattgtatttcgaccagaaactgaatgaataattagaacatcttctttttgtattggcgtatgctctaaaatcaatgtcccataaccaggtagtctctccatttgcgaggttagagttattggtcttacatctaattgaacttcctttgccataattggattaattaaagccaatccaccagcccgataaaacagttcttgggtaagaattcccgcatgagaagctccaaaagcataaatcgtatgtcccttttcaatacattgggtcatttctaaggcagctttttgaatagctgcttcttgtgaatctacaatattatttaaaatatcatgaatatgctgatagtatcttgatcttgctttcatcataaattccttatccgataaaaatatttatccactaatttatcattatgatcagcacaatcttcattcataaaagccatatgaccattgtaataaacatccgggtgaattccctttttaactaaaatatcaaccatttcacataatattgcattttgtaaaaagacatttggtattgtactagttgcccccactttcataggaaaattttctatctcaattgccgcatcacctattaatgaacaattatctaacactacatcagcaacatctttaagctttactcctgccttatgttttgtctttaagaattggctatattccactgcagtaatcgcaataataggaattcccttttcttttgcccttatagcagcatctactggtgcaatattattgccagaattagaaataataatcatgcagtcattaagggtgattcgatgataatcaactatcatttttccaatttcatacatattttcaatgtaataactttttgtaatttcaaaactgcctgttgcactttgttccagcaaagcacaataattagccggggtagcagctcgccaaaatgcatcatcgactactaaatgagaatgacccgtcccaaacccataaataagacctcctttttcagttgtatcagcaagtatttttgcagcttttttgatattatctttttgcgtattttttacttgtgcaacaaccttttccataacttcaaaataattttcccaagcttccatttaaaagcctccttcctttacaatttcattatacctaaattcaaaagagcaaatatttgcaaattctttcaatttcttgagaagcattttacaagttcaataaaaaaagaaatttgaaataatatccaaatctcttaaaatacattatattttataatgaaaaaaggagttttaaattaataaactccgcgactctataaactttactttattcaaacaaggcacttcctacccttatcatcgttgctccatactttaacgcttcgtgataatcattagacatccccattgataattctgtcatttcaaactctgaatatttacaatttaattgatcaaataactcctttgtttgtttaaaatatactgctgtatcattagaatcaatatgtggtgccatcatcattagcccttttacaattaaatggggacattcttttaaataatcaaatacatcttcaatttcttctactgcaaaaccatgcttactttcctcttttgctacattgacttggattaatattggcatttttaaatcatgcttcttagcttgtttttctacttctttaattaatgaataactatcaattgaatgaatcaagctaactttatcaattatatacttaactttatttggttgtagcgttcctatcatatgaaattcttgtgccccatgatacttttcatatttttctaaaaaagcttggactcgattttcgccaaaatactttactcctagtttttctaattcattaatctcttcaattccaacatattttgttgctgcgaccaatttagcattaccaaccgattttaaaatattttttactgcctgttcatttactctcatttactgacctccatagactaattgcccacctacataagtagccaatactttaatgtctttaatatgctgaacatctacgtctaatatattatcactaagcacaacaaaatcgcaatactttcctacctccaaagttcctttgacctcttcttcaaatgaagcatatgcaccaccgatcgtaaacgactcgatcgcttcttctctagttaatgcctgctcttttagatatggtccagtcccatcgatagatgttcttgtaaccgctaattgaatcccttttaaaacatctggggcttcaactggacagtctgacccattagaaatagtcgttatattacgaagtgttttaaaattatatgatgtttgtgctaattggggagaaaccctttgattaataatatgattatcataatctaaaaagacactttgaatataagcatgtaaatgtaactgctgatatttaagcaactgatcttctcgagtgatctgacaatgcacaataccatgtcgtggatcttcacgagaatagttttttaacgcattttcgtatccttcaaaaatccaatctaagattccatcaccaattgcgtgaatagcaatctgcatctcatgacgattagcgtagtcaaacatcattttgatttcttcacgactaaaaacaggaattcctcgtgtcttaggtgcatcataataaggcttacttaaaaaagcagttcgtgctcctaatgatccatccccaagcatttttaatgggcctattttaaaaaactcatcaccactaccggtacaataacctaaattaataaactcttttaaggcttttaacgtcggcaactgtgcttgttcgtaaactcttatcgttagtttattttctgctcttaattgttcaaaagcctgtagagcatcatgataatcactagtggcactcaagagatcgtcactttgaacagatgttattccataactatgtaactctttttgagcgattaaaatattatcttttatttcttcaatagttggctgagggattgtatcatagatcaaataaagtgcattttcttgaaataatcctgcatctaaatcaaaatagccgccctcgactgcttcactggtaatatttgctaattcaattgctttgctattagcaactaagatatgtccacaagtccgcgtaattacaatcggttcctcttcactaatcatatcaagatcttttcgggtaggaaaacgctgttcatctgtaaaataatcatgattccagccccgcccaatcagccactgcccctttactaaatatttctttaattcttctaaaagtgctttaagcgaattagtatgcttttctaatagaacattttttaaactttgaccataattaactaaatgcatatgcgaatcattaaaacctggatatacatatttattatttaaatcaatttgttcaccagaatattttaatgcttccttatcacttccgataaagataatttttcccttatcttctacaaaagcagttgcctgattacaaccgtataaatttccccggaaataaattctcataaaaaaatccccctttatttagaaagtaggatactttgatcctacttttcattataatattttgttatatcgatactagtaactgcagcaacatcttgaccattgatccaccgaacacgttttaccgttgtctccaactgagcactaatgttacaattataaatcaatttagtatacgataaatcgctatccttcatatctttaattgggcagtcagcgcatggttcatcatagcctctaaaagacttatagcaataatcaccaacttttacctgattaaaaatatgtttgattttatgattataatacacaagtttataagtgttgggatcaataacgtaaatcccattttcttggaaatctaaaatcatttgaattgcatttaaatactgattcttttctttttcctgatattttttaacaagaaaagtactaatgatagcaatcgaagttaataacatttctttttcttccgctttataagcgtagggtttttcatgttccatgcttatgataccaataatatcatcgccatttttaataagaccactaattaccatacgggtcttactattagcataaagtgttttaattgctggagaaacatctgaagccttgatatcattaacccaaagaatcccctcatcatcaaattgccgtacatactcaggccaataatcatgataagtaacatcaataacttttgttaaatcttcattctttgaactccaataattatttactttgtatttcccaatatccaaatctcgtacaataattaaattttggctcatataataatgcattcccaataattctaggactgctgtaattgtttcatttaaatcttgacatttatataaaattctaaaaatatactcaccaacattatcagaaaactttttggtagcccgatcaacaatattattcactttatccaattgaccatcactaatctctaaactctcatcatacaaacaaacaccatttttattattctttttaattttgtataaagcctgatcaccatggtgatataactcatcaaatgtttttccatgattagggtataaaactacccctacagataccgttactttaacttttgttcctccagttccataagcaccttcaatcagtttacatagatcattagccttatcaatagctagttcactgtttgaaatattcttcattaaaactaaatactcatcaccaccaagacgagcaactaagtcatcatttcgaaatttagattttatttttcgagatatttcacacaaaaatgcatcaccgtataaatgaccgaaattatcattaacctgcttaaaattatcaatgtctaagatcataatcgcatgattattttcaggaaaattttgaataatttcatttgttttaatttcaatagcttctcgattatatagccctgttagtggatctaattcaattttcttctttagtacaagatcatgtactttattttcattaatatccttgatataaccacaagcataaatatctttattaaattcaatcaaatatagtgtaatttgaataaaattataattatctttaaacttattatagaattgatattctaaatctaatttacgttttccatcacgataattatttaataaattttgccgatttaattcacgaagcactttgccatactcactaggaattgaattttcacttagttttaaaattgatttttcatagtttttaccatcataaaaatcaataaaattattttttgctattttccgatcaataacttcattcatcgttaaattaacttcaatataactcagtgcatctttacctaaagcctcacgatattctcgttcaatttcatacttgctctttagttcaacaaaatccgtaatatctttaccgattccaattgatttaactgcacgtccctgctcatcaaagattgttgaacattttagactgatccagcgttcttctccatctccacgcttcatctttaattcaattgaagtttcaggcctgcctttttcaatctcttggcataattttcttactcgtaaaccatcctcttgactgatgatctttgcttcaaccaaactttctgggatattataataagttttattaatatctaaaattcctaatgcaacttcatcaggacaaaatagctgctcaattgtatgatttaacacatcatattgccacaatgttgtatttgcttgttttaaagcaagcttataaatttcttcacctattagaagctcctttttcatatttgataattcggttatatcggtagctacgataataaaaccttgcggattgttttggttatcataaaatcttgaaactgttactttttctacacttccatctttatgaagattatctaatggttgtaaaccgtgaaggtaacgcataatacagcacttttccgtactacaattatccattttaagagctttacaaggctgcattaatacattttcacctatcagcttacgacctttccggttcacaaaaagtatcttcatttcattatcaattacgagaataacattatcaataacatctagaaggactttatattcattatttagtttatccattaactcttcgatatttttgaatttcaatcctgacacctcctagactactataattatattgtaacttaaccattaataattgtacaatcctaaaacttgcaaattttcttactgtccttataaatttattaaaaactgtatcttttttaatatccagtgtaatgttaagatacttatagatttaataaatagggggatttttatgaataataaaacacttaaaatagcgacaattggtttgatggctgcattagcctatgtctcttttacttttctacaaatcaaaataccaacgccagggggaactacatcatttcatttaggaaataccttttgtgtcttagctgcattattgctagggggacttcctggaggaattgcaggagcgattggaatgggaattggtgatctacttgatcctgtttatgttacctatgcacctaaaacaattatccttaaattaatgattggaatcgttactggattagttgcacataaaattttcaaaattgaaaaacatgataatgattctcatttaataatttatgttgtcatttcttgtatggctggaatgttttttaatgtggttggagagccaatctttggctatttttataattcgatgattttaggtgctccagaaaaggctgctgccaccttagcaagctggaacgctattacaacttcagttaatgctgttattactgtcgccttagcttctactatctatttagtcatccgacctcgattagctggcagtggtatcctggtaaaattagcacctcataaataagcttttattaaaaggtaatattataaaaagaacctccattatttggttgtccaaataacagtgtccatttcataatactacctttttttatttaaattgactttgtttcgggaatagcccaaagattccaccagtatgcataaataaaatattttcactatcaacaaacgttcctttttctaattcattgatcaaaccatagtatgccttaccagtatatacaggatctaatactactgcttctaatttagctaaagatgcaatagcatcaagttcttcacttcgacttaaagcatatccctgaccaacataaccatcaattatcttgatccgctctgtttttatttcctgatcaaaatatacttgcgcctctttaataatttttgttatctccttaataaagtattccttatcatcgcaaacattaaatccaataatttgttttttagtacgattaagctcatttccaatatataaacctgcatatgtccccccactgccaacagcattaataattgtatcaaattctactttcatagcttcttcttgttttaagatttctgtaaaagcttcaacataacctaaagtaccaattccattacttgctcccattggaataatatatggtttatatcctttagcttcataggcagtttttaatttcagcatgatcttatccttatcacgattaaaaatttcaggttctttgataacaatatctgcaccaactaagcggtctaaaaaatagtttccttcgactggctcactacttccattgccacgaagtaataagcagcttttcattgataacttagctgcggcataggctgttgcacgagcatgatttgactgcatacccccacaagtaatgactaaatcacaaccttgttcaaatgcttctctcaatgaatattctaactttctaattttattacccaatgtttctattccagttaaatcatctctttttatataaatatttttttggaattgtttagataacttctctagtttatatattggtgttggtaaaaaagccagttctactttttctggtaactgcataatttatcccccttatccttattttttattatatcataattgaatagtttcacgtgaagcttttaaaaaaagtaccacgattatggtacttaattaggaatatgatatttttctaaataagcttcaaagacttctttatctttactgctgccagtacaaataaaagcaatacctttaggacttccaagataatcaacaatataatcaatatattctaattcttctttgccacttatattaacttgtagtagtaagcccgcatcatgtactttttgataaatttcattccagcaaggatcatttaatggttttgctccagcaccattgatccattgaattcctttaaaaccacattcaatgatcttatcaagatgacgtactgcaccaggaccatctaaatgatagaatgaacgctcaatcaaggatgcctctttctttaaggtttcaaaaacaaactcatcaaattgctctggaccaatcatacaacaaaaatcgcattgagaaataaaatatggtttttgtgataatagactgatccatccggtataacccaaagtattatttaaatcaatactagcaatcatctcttcataggcttgttcaaatgctttgtaaatgtcatcatttaaacgttgaacttcatcaggatcatcatataaatcaattagtgagttatttgcccctctcattgattcaacgatatccatcattcctccaagattagcaattcccattgcaatatcatctccataaaactgattaaatgctttgattagttctaatgatctttgatataagggatatgtttcctctaggcgaggatgaatatcttctaactcacatcctttcatttcttgaaaccaaattgtcccttgttttacatcaatatgataagtttgacctaaataggctcctaaaactccggttgagcgcatataaaagataggaaaagcatcacccaaataaatattcgaaaaaaatgtttcttgatatgcttgaactacctcattaaccggcttatctaaatcatatagcatttctaataattcccctcgattatatcggtgtttttgaggttgataatcttcatcaaataaagttacttgaataattggccgttctaatttatgctcccaccatttttcaaaatcttcaactaactgttctttttttgctttagttaacataacgtacctcccacgattgcataagcaacttcacttgcactagtggcatcatctgtataataatcagcgcctatttcattacaataatcttgattaacaggtgctccaccaatcataactttaacatttaaatgttcttgagcaactaaatcaactacttttttcatttctggcattgtcgttgttagaagagcactacagcagataatttgtgcttgatgtatttttgcttcttcaacaaatttttgtgcatctacatcgacacctaaatcaactacttctaaaccttttccttccaacatgatcttaactaaattttttccaatatcgtgaagatcaccttttacagtaccgagaataacggttcccttactttgatgttccgtatcttgtaaatatggctttaaaatctcgattcccttattcatcgcccgagctgcaactaatacttcgggaacaaaaacttcttcatttttaaattttacaccaatggcatccatacctttcaacaacccctgattaagaatatccgttgctggaaagccagcttctaaagcttcatttaccaatttgacaacctttttagcttgtcctttttgaattaattcactaatttcttcaatcatttctactcctccattatctcaaatacttgatcgatatcactactaattacaactttttgatttttttctaaaattactaattcattactagtttgtaataatatttgttttaaaaattttaaatctattttaatttgttcctgatttttaagaaaaggaacatcgtcacaataattataaattaggtatacattatcctgcgtttgtaattgggatttcaaatagtctgctgtttcttgatcgtatcgctgacaccactttaaatattgttcatcttcataaacattacagccattaacttttaaactataacagctccatgaagaagacaagcgatttgaaaataattgtttaaatcgctgtttgctccccaataaaacagttaaacaatcatgcactctaactagatatacaggaatattgcgtgcttgtatttcaactaaagcattaccgcaaagtccgtataaaacaattattttttcatcccccctgctcttatcaatttctttttggatattttttgctaaagtatgtggttgattatgttgttgtatatctagatatacaaattcataattatcaagtgataagtctagttgtgaaatataatattcgtatattttgcaagcaataacttttatcatgaaaacaccatcgcatctatccaataatcattaaaatcaggatctttttctaaatagataacttttgtttgattactaatatgttgaactcgctgaaaatctcgtgtcaatattagtttataaagaccactgatagcactatttttaatatattgaactttgttagcttcttctgaactaataatattcaaggtaacaagatccgctttctccaaataatttccgaagccacccgcaatataaatagttgttacttcatcattcaattccttcaataatacttcttttcccgcttgaattgctgcttttgctaacataaaagcttttatatctttaattgataaatatacttcatcatttaaatagtattttttttgcttatttaaaaaattacctgtatcatcaataattcctaaacgtagcaaattagcgattaaagaaattaaaccactaccacaaatactattagcatcttgattatcaattgttttatagacaagcttattattttcgactttagtcgcacaaacagcgccagcaatacttggaccaccacattcaatatttaccccttcaaaggcaggcccagcaggacaagatgtcgctaatagccgatgcttatttcctatcaccatctcaccattagttcccaaatccatcagtaatacattttccttgtttttatccatattagtagcataaattcccatgacaatatcactccccacataagcagaaatatgattcatagtcataacttcaatctttactgaactctttataaaataatttaaaggatattcagtcattgttaagattggtacatcaaatggtgatactccaattgtttttaccttttcttttaaaaacaaattaatcattgttgcattaccacaaactaatatttctttgatttttgtagacacattgattcgactaaatatttctttaattattagttcacctaatttatgatcattatcacgattatcaaaatcaattcgagcaatcacatcacttccaaatttgccttgaggattaaagaaagactgactttcaataatcattccgctttttaaattgagccatttcattgctactgttgttgttccaatatcaatgataattccaactttctcaacaggttcggtaattactacggtatcatttaaatatatactatcctcaataactccgtctgcttgtggcaaaataaatcggtcaccctgatgatataaatgactgcaggctaaacgatacccttgatccagctcttttttagtaagcagttttagatcatcatgattaacctcgatgattcgattggtagcttttactttacattttccacattttttttgaccattacaaggggcgataaaattacaatcttgttcctgtaaatattcaagaatcgttttcataataattttcacaaacttccataaaagctttaatatttttccatggggctaatggagggatatcacaaccactcgaaataataaaattacgataatctttacactcttttaataaatttagtgtaatttctttgattgtttctggggttccgttactaattatttccactgggtctatatttcccataacaagacaatcctttggcattagttctagcattttttttatgttaatagcattaccaaaatgatatgctcgtgctttaatttctttaaaatcatcaatcatttttaaagtattattaccacaattatggtatacgaccataaaattttcatcttgaactgctgtaactatcttttttacataggtactagaaaattcagtcgccaaaactggcgatagcaccccagctagtggttctgccattaaaattccatcagctccagcttctttatacgctgaaatatagtcgatcaaaaattttgtagccttttctaatacaatatgtaccatttctggctcttcataacaattgatcattgcttcacttacatccattaaacgaccagccaaactaaacggaccaatacaacctcccaaaatagggatatctttaatttctgctttagtttttttgattgcatcaatatataattgacttcgcccgcttcccactgcaggaacctttaatgcctgagcatcatcttcatcttcaattaattgaccaactactgtcggtacttcgttatcagtaacttttatttctgcaccaaaacattctgcttcaaccgataaatccataaaacctaaaattgctaatggattacactcctctttaattatcttaagagctgcaacttgttgatcggtatcattaattaattttttgacactaatatttaactttgttgctgctggaaaggtaattattggcattgctcgtttatttttcttctctaatacatcatttagccatttttctatttccatcatattcacctctatatatatcatatcataaatatattattgtctatacaattttctgaaataaaaaagttatatttctataaatataactttattccggtgaaataatatttttagcctctcctaaaccatattcaattaaataatcacgaacaacattaagtgaatgattataactcgatgatatttcgtcagcaaaacattctgcttcacctaagcaaagatattctaatgcctttttacttttaatgttaattatattaatactttgcttttcacttgggtaaaaagcaaaataataaccccaataaataattttattagtttcttgtataattgttttaaacggtaacagtggtaaattgtcaactatacaattaagcaaacattccaacataagattctttgaatcttctatttcaccctgaagatttttgatcttttcttgcgtaatatttggaaaagctaaggttgcagcttttttgattaaaattaccattgcctgaacaccgtttaaatataataaagtatcttgccggtattgtttattttgcatacatttaattgcagtctgctcatcttgtatcactaccctagtacctttaacattcattgtttcaccaaaacctaattcattcaacatatgtagactttttctaattgtagaaacgctaactttatacattttagctaattttgcttctggcggtaaaaagcttcccactggataaatacctaatgagatcttattaattaaatcacgagctatttgtgtataacaatgatctctgcctaattctgcagaccaggtatagttgggtgtcatttcttttatttcaggatatttaagagctaggtccgttaatgttttttcaataacattgataactgtatcgtacattaaaccaaaacgatattcaatttcacttttatccctagttaataacgaacttgtaacccatgtaatacttttaaaagtatattctaaattaaaataattaatatatttttcataattaacaaagaatactggtcttgcatatatttctaagctggagaaaatatctcgtaataaaggattatgtgatttatctaacagttcaaaaaatattcgagtacatatccgttcacgttcctctgcactcttatcttctgattcttttaatctttgagagcataattgtaagtcttcttcatcccatatctgtgctgcaaaagaaaaaattaccggcataattaaaccaatcgttttatacacatcgattatttcctgacgatgctctaatacatattcaaggccatcttctttgaatttactatgaatgttatacacaacggttgtcgctttacgttcatgggtcgaaatatagccctcttcttttaatacgtgcaatacatctttaaccgttcgaattccaatattgtaaaattcgcacaactcagaaattgatggtagcttcgagccataaggaagacgtccacttacaatcaaatcatgaagattgttgtataaataattaaataacgtttgtttttgcttcactacgatcaactcctttatcgttaaataggcacataatattaaattacttagatttatttatataaatataattttatcacaaaaaaaatctttctactatatgcttatgtacccaattatttaattgtttatttttacggtaatgataaaattaaattgatataattttatagttgggagttttttataatgaaaaaaattggtaaaaatatagttaataaaaaaccttctatctaccctgttggtaaattaatatatatttatataattttaatcgtcataattgtcttgatgatttttaatacaattaatttaaataatactttgggctcaagtaccaatacttatgtaaacgatgttacttcacaattagcagatgatatttctatgcgaatcgaagctataaaatcttcgttaagactattatctgattcaataaatattttgcctgataatcaagagatttcttcttttcttcaaaaaaaatgtgaaaatttagaatttactgatttgtttgttattgatgataaaggcaatacaattcccgagcaatctgaaacatttgatttatcactagtaagttcatcatttaaaggtgaaaataacctaatctatcttgatggtcagagtcttcttttttctacaccgatctatgatgagaaaggaataacaaaagtacttattggtattcgtgataaagaaaatatccaaaatttaattaaacctaaaagttttaatggccaaggtctatcttgcattattgatcagaacggtaatgttgtcatttcccccactgatcttaaaccatttatgcagttagataatatctttaaagatggaacagatactgatgctgtaaatcatattaaaaaaatgcgtaaaaatatcattaatggtaaatctggtgtttttgagtttactgctagtgatgatacttctttaataatatcttatcattatcttgaccataatgattggacattattaaccttagttcctggcgaactcatttcaagtggtacaaatcaatatattttctataactttattttagttgcttgtgtcatttgtgttttctcagttcttttatatttaatttttctatcttacaaaaaacacaagaactggttagagaaaattgcctttactgatccattgactgcaggattgaataatgctggttttcaattagatgcgcaaaaattagtaaataccgcgcccccatctaattatacggttatttttttagatattaaacaatttaagttgatcaatcagaattatggctttaataaagggaatgatgttttaaaacatatttataatgttatttacaataacattagctctaatgaacttgttgctcgaagtgaaaatgatcatttctttatttgtctaaatgaatctaataaacaaattattcaaacacgacttgatatgataattgctgaaattaattcatttgcaaagaacaaagcatcacaattaactatcttgcaaggcgcttgtttaattgaaaatcctaattcagaaattaatattattcaagattatgctcgtttggcctgccgccttaatagtaagaaatcaaaatgtacttactatgataaagaaattttggataccatgaaaaaagaacaggaattaaatgatttatttgagaattcaataaaaaacaaagattttcatatgtttttacaaccaaaaattattatttctaataataaaatcggtggagctgaagctttagttcgctggttccatcctgagcgaggaactatatatccatctgattttattccacttttcgaaagaaatgataatattattaaactcgacctatatatattcgaagaagtatgtatctttttacaggatatgattgctcgtggtgaaaaaccatttgttatttcagtcaatgtctctcgagttcattttaaagataatgatttcttaaaagcatttgcaagaattaaagaacaatatagaattccaaataatttgattgaattagaacttactgaatccattttctttgataatcagcaaattgaaagtattaaagatacaattcatcaaattcatcaatatggtttcctatgttctctagatgattttggtgctggattctcatctttaggattattaaaagactttaaagtagatggcataaaaatggataaaaagttctttgatgatataagtagtcaaaaaagtaaggatattattgccaacttcattgaactagcagataaactgaatatatcgcttgtagctgaaggaattgaaactttagaacagttagaatttctaaaatctgtccattgtaatatggttcaaggctatatttattcaaaaccactacctgttgatgaatttattttatggttaaaaacaatcaaataatagttatttaaaaacaactataatgaagtcccctcttcagttggacacaaccagctggaaggggttttattatggcaaggctaacaaaagaacatatatagaaatatataataagtgaaagcagagcttgctataagtttattatcaaaaatataaaataaataagaacggtatcctgtatttgataaaaatcattaataaacacatatatgatattttgcaaaaagataagaataatcattattcttcaaaaactaaaactagaaattatcaataaagttttaatagataaacaaggcccagaatcaaattcaatcgattctgggcttacttcattttaactactcagatgtatatttaaattcggtagcatcaaaactattgacaccacaatataaaggattattttcagcattcttttcaataattgttgtttgcaagattggagcattcttagcaacttctaaatatgttgcaagttttttagatgctaaccgtgcctcaacctcaattgaacgattggttgcctctttaacttttattgtttcatgaacaatttggctcattgatcttgtgcaatcaatcttatctagtgaattaaaatagcgtttgggtaagaaaatattttcatagacaattggagttttaccaccatattgaactctctttaactgatatacttcctcatcagttttaacatcaagatatctaagtgctaaaggatgatttacaactgtttttatagagactaccttaattataactttaccataagttttaacaatttcttcatcagtttggattgatactttagaaatactacgtgactttttatttttagcaataaaaacaccactgccagactttctaattaaaactccatcttgaatcaattcatctaaagctcgacgaattgtcattcttgatactcgatatttttcagtgaattctcgttcaggtggaagcattttatcttcttgataaactccactttggatatctttaagaatatcctctttaataaatggatataaagaagccattaatgtatttttgtcccgtttggtaaattttcaacgctaattacttctaataatccctttttatctccagctaaaatcattccttgtgactcaatccctcgtagtttagctggttttaagtttgctacaacaattacttttttaccaacgaattcttccggagtataatgatcagcgataccactaacaatttgtcttgtttcttttcctaaattaatttgtgatactaataatttatcagcatccggatgttttttgcattcttctactgttccaacaattaattcaattttcttaaagtcatcaatagtaattgtattatcttcttttggttcttcttttacttctggttttgccggttgcaatgcttctactttcttttgaatttcttttggatccaaacgagcaaataacatttctggtttttcagctactttggtaccttctttatatgttccaaaagtatctaaagctaataaatctctttgatcagtattaatttgatctaaaatcttattagcagtagatggcatatatggaattaacgcaatcgctgcaaaacgaatactttcaattaagttataaagaactgtcgctaaacgatccctttttgtttcatctttagcaagcgcccatggcattgtttcatcaatatatttattagttcttcttaataatgtaaagatggcatcaagggcatcagatgacttaaattcatccatcttaccaattacttttttaggcattgctaatgctatttcaattaactcatcatcaactgcttctgtaacttttgggttattaacaattccgccaaagtatttatttgacatagcaatagtacgatttactaaatttcctaagacattagctaaatcagaattaattctttctactaaaagatcccaggtgatgcttccatcattatcatatggaatttcatgtaaaacataatatctaactgcatctacaccaaaaatgtctactaaatcatctgcatagattacatttccttttgattttgacattttactttcaccttgtaataaccatggatgtccaaatacttgtttaggtaaaggaatatctaaagccattagcataattggccaataaatagtatggaaacgcacaatatctttaccaattaaatgtagatctgcaggccaatacttttgatataattcgccatgattaccatcgacatcataccctaatcctgtaatatagttacttaatgcatcaatccatacataaacaacatgtttaggatcaaaatctacgggaatcgaccaagtaaatgaggttcttgatacgcataaatcttgtaatcctggttttaaaaaattattcatcatttcattctttcgtgatactggttgaataaattcagggtgtgtttcaatatgttcaattaaacgatcagcatattttgataatttaaagaaatatgcttcttccttagcatcatggacttcacctccacagtctggacattttccatctactagttgtgattctgtaaaaaatgattcacaagccgtacaatatttaccttcataatgacctaagtaaatatccccttgatcatataattttttgaagattttttgtacttgtgacttatgataatcatcagtcgttctcataaatcgatcatatgtagtatccattaaatcccaaattctttttacttcaccagctttttcatcaacaaactgctttggcgggattcctgcttctttagcttttaactcaattttttgaccatgttcatctgtcccagtttggaaataaacattatatccttcttgtcttttaaatcgagcaattgcatctgctaaaataatttcataagtatttccaatatgaggttttcctgaagtatatgtaattgcagttgttaaataataatctttttcattcttcatatatatttctcctttatttttaaataaaaaaacgccctaataaaaggacgaataatcgcggtaccaccttttttacacattgctgtgtcactcaatacttttaacgcaagtcaaacgattatctttaactattcaagataacagctccggggccatcacttaaagtttaactcttagtttccacctgccactaagtctctatatgcgccactttaacatcttcccatcttcgctttttccactcttaactttagcaaactctaagcctaaagtcaaattaaatttagactaataatgttcttccatatgaattatctattataaatatctatttttcatttattaaatgataaacatatgttgcccgttgttccatactatattcactagctttaacattattagctgttaaaaaattttgtaataaaactagtattgtatcatcagcttttaaaaatcccatcttctcttgggtgggaacaatagtatgtagcaattttaataagtacttctttaatttttaattatttctttgctcacatacttaatcctttctttgattcaaaatgtttcacgtgaaacattttgaatcaagcattaactctctttaatatttttttatttctgttgaaacttatttattgcttcatataattggaaaaaattacaatcttatcgtggatataattctacctcgatagcagtaataattagacatttattttaatatttaaacaatttcacaataacttacctttatttttttattaatagcgtatatcttatagaaaataatatatccattactatctaagcactcacaaatatcttattgctaacatatactactttgcccagtaatatttatagatagcaagttgtgccatactatcattgacttctttaaaagaatcaaaactaattaatgtataaatataatttttattttagcttaaccacagttattattttctttatgaatatacaatgatttaatatctaagttaaaaatctattagaaataaattattcattattattttattaataccaattattaaaataactactcttaaaacattatcatatggatttaaaaatagtttactttcctccactacacaaaatacattattttttcttcatattagctatgcttcaaataagttaatgtgatttctcaataataattacttaacctatcttcacaaaaaatatcttacaatatttttgctactctgttttatagacaaaataagcatatatactttgtttacctttacaatatgctcaatattataattcaaataactacttatcattttatatatgcttacaggttatttttttacttactactatatagtacctatatatatcatagtaatcgcctcttaaaaagtatatattatactatgtatttatatttttatactaacaactctacttagaaaagtatattaaacaaaaaatgtttcacgtgaaacattttttgttactccaaggctgattcaactctaaataaactttttgcatttcttcatcagtcttagccatcatatcggcacaccattttaaacgctgtttaatatcattattagcaacaaaattagttttataagctaattcatgctccaacgatgcccaacagtccattgcaatagttctaatttggatttctaccggtacttgcatcatcccttctctttgataaacaggtacactcacaatcaaatgcaaactacgataaccattctctttaggatattgaatataattattgtgttttatttgtattacatcatcttgtaaaactagtaattgtgcaatgtattgaatatcattgatatactggcaaatcactcgcaggccagctatatcatttaactctttaatattattaaagttcttactaaacccctttctttctaatttatctaaaatactttgtggagatttgattcgactctgaatattatgaattggactatgttcacatttaaatttcaattcttgatctatgatttctagtttagtctttacaatcataatagctgcccgataaggttgcatcaattcttcaaaatgcctctgttcttgaaaagcattaatcatttcttgattcatttaatcaccccaatcatgattatattaaacaattgcataatagatacattaaaaatatggttttttgtgtaaaaaaaattcgctagcatatactagcgaaaaactgttttcaaatctttatattgtttaagcgtatcaagagtaacaaattgataaccacggttataaagttctcccaaagccatttctaatccctcaacagagaaattatgaatatcatgtaataaaactactgcaccatcatatgaattattaataatagtctcttttattttattagcatcttttaacttccagtccaatgtatcaacactccatagagcaatttccattccattatttttgactactgattttacattatcattgaaagcaccatatggtggtctaattaatgtaggttcagcaccagtaatcttataaattgcattttgtgtatcaacaatttgtttattaagtccttcagcatccaactttcttaaatctggatgatcccaagagtgactagcaatctcaaaaccatgttcatagactgtttttaccacatcaggatataaagtaatatttttccctaattcaaagaaagttgcacgaccattatatttttcaaacatttcaactacttttaaagtatttgttttgtgtggtccatcatcaagagtgaaagcaatcattttcttgtttggatcaacttcaggctgagcagcaggtcctgcaacatctaaaggtgcatctgaaggtatattcttattcgctaatttgattaattctttattatctttataattaacttcaatcttgtttttcaaatcttcagtagtgtaaataattaatttatctttttctactgttaaattgttacttttagcatctactttatcaattccttgactactagctaacactgttttaaaagtatttcttaaactgtctccaacagttagaatcttttctttttttgtatcataagtaaataatttttcttttgtttctactactttgtcatcttcatcataacgaatagttttaaattttaagttaataaactgattatatacttcattgattgagtagtccatgtataatatatctttactatttttattaatcttttgttcttttacataattttcttgataatctttaacaattttatctaaattactgttttttgtctttggataatataatgaaataaagaaactatcatcgtctttttcatagtgttctactgttccaaatttcttgttatctttattatatactttatacttatcatacggtccctcgcggttaataaaccaaaatattcctcctaataaaattgctataacaacaattactactagggcaattgttggttttttctttaattttcttctattatttattgcgtgcctatactccataactttcccatcctttcgccatacatataatacgatatttgtcgaattaaatcaaatttattgtattgctaataaaacatcttttttaatgtttcacgtgaaacttttaagaattttatttaattgaaaaagacgaattactcgtccttttgatgatatgtagcatatacttcatttttcttaatatttcttaatttagcaacctctttaattgcatccttaacagtcattcctttgctaacatattcatcaacatgttcaacaatagtttgctcaaaaactgtctcttctataacattattattgccagaaacaacaataaccatttctccctttaaatcaccagcaactttagtaatttcacttatagatccacgtaaaatttcctcatgttttttagttatttcccgacaaagtgcaattggtcgatctccaagaatatcttccattaatttaagtgtcttagtaatacgatgcggagattcgtaaaaaacaatcgtttcttgataattctttaatacctgcaactcttttttcttcttcttatcttgatgatctaagaagccataaaataaaaatggttgcggagcaattccagaaactactaatgcatctaaacaagcattagccccactaattggaattacatttatctcattatcgattgcagcttttactaattcataacctggatcagaaatagctggataaccagcatcactaactaatgcaatattattaccatcaagcaacaaattaatcaatttaggaatcgattgccctaaattatgctcatgatgggaaattaatttagttctaatattataatgatttaatattttaacagtatttctggtatcctcagcaccaatataatcaacttcctgtaaagttctaattgctcgataagtcatttcttctaaattaccaattggtgtggcaactaaatataaacatggccggtcattttgaaaacttttttgtctattcatcaatattttctccaaacatttttcttacctcattactataactaccatctgcattatgtgcatataaaggtggttcaatttttaatcctttttttcctttatacattccttcaactaataaaacatgactgtcgcgatcaatcttaggataaacaaaacgaattctttttggttcaatatcatacttttgcattaaattcaaaatatcaatcatccgatcgggacgatgaaccatggcaaactttcccttattatcaagtattcgagcagcactctttataattccttctagattaatcttaatttcatggcgcgcaattgttaaatattcattttcatttaaattactatcctcatctactttgaaaaaaggtggattacaaataactaggccaacttttttagcatctttgacatattctgcaatatcagcgtgaacaatattaatctgtgtttctaaattatttaattcaatattcttaattgctaaatcaactgcttctttttggatttctatcccagtaatcggacgattggttcgctgtgataatagtaacggaattgccgcattattagtaccaaaatcaataatttgtttaacatctttagttatggtgcaaaaattagctaataaaacagtatccaaagaaaaattaaacatatcttttctttggataattttcatattattataagctaataaataatttaatacttcttgatcagacattatttattatctttttgtttaaacttaatttcatcaagattaacaaagataattgcaccaccattatcgatcttaacaagatcattaataacattaagtcctaatactttaacatcttttccttcatattttactcgactgccaattttaggaaaacgttgtttctcaattgtataaacttcatcttcatacttaagacagcacatcaaacgaccacaagctccagatattttttcaatattaatagctagcatttgattttttgccatattaattgatactccattaaattcaccaagtaatgatgtgcagcaaagtggtaatccacaagttcccatcccacctattacttttgctttatctcttggtcctatttgtcgtaattcaatacgacatctaaataccgtagctaattcttttaataattctctaaaatctacccgtacatctgatgtatacataaaaatcacttttgccttatctagtgtaaattcgcaattagtcaattgcatgtctacatcataacgtgaaataatatcacggcaagtaactagagcttcttgggcatcaattatatttttcttataggcttcaatatcacgttgtgtcgcttttcttgtgattttttttaattctgtatctaaattaaattcacttattgattttaatgactgtgaaatctcaccaagttctactccacgtgctgtttcaactactactttatcacctttatctaattcgatatctgttgaaaaataataaactttaccagcacttttaaatttaacacttgccaatttaattttttccataatatctcccttctatagtctatacatcatactatccatcagcatcggtacattagcattgctttcgatagtataaatagtttctaaaataatttctatttgtttaatcaattgactctcatcaatttttatatttctcaaaaattcttgatgttcacaatatacaatatcatcagtatgtttcacgtgaaacatatctttcatcgctaatactaacatatttaaaaacaattttatatcatcacgctctttatatttttttaataaattagtctgagtattaataatcaaattagctctctttaaaaataaatcctcaataaaatttattacttgcaattgcatatattcaaagcgttcatcgtataaagtcttagcttcttctatactaggggccaaataagctaaaatatgagcagattccttagtaatgccatcttggcacaaagcaccaattataacctctttgctatcaggcttgatatcaattacctgacatctagataaaatagttggtaatacccgactagcattattagcagtaaaaattgcataaatcccctcggttggctcttcaagcatcttaagtaacgtattcatcgcttcttttgtagcatattcaatattctcaattatatatatcttagcttttccttctaaagaagactttttaaaggtatcttgaatcagttcaatattacccttttttatagaattatctttaccattaaatcgaataatatcactatatttattttctttaactttacgacaatcattacaattttcgcaagctaatgtttcatcacaaatcaatgacattgcaagataagtcaaaggaatgttagtattatttccaattaataaaaaagcatgcggaatccgttgttgtgaaaattcattttttattaaattataaaaaatcggttgattcttttctatgtactctttcataatttactcttaattacatttatcacttgcgcaacaacttcatcgattgtcttacttgcatcaattttagtaattcgctcagcatacttttcacaaatcgtcatataaccattataaacatctttatgaaaatcatcagattctaaatctaagcgatctgccactcgctcaccgttattgatccgagctagtcctacttcatatggcaagtcaaagaaaatagtagcatcaggtttaatattaccaattgcaaactgatttatctgataaacttcctctattcctatttttctccctacaccttgatagaccaatgaactatcaacaaagcgatcacaaattacaatatatccatcgttcaaagccggagctactttttcaactaagtgttgacgtcgagctgctgcatataataatgcctctgttcgtgcgtccattgtaatattattagtatctaaaataatcttccttatttgttcagctatatcaattccaccaggctctctagttaataatactttatatccttccatttggagctgttcaacaactatttttgacacagttgtttttccactaccatctggtccttctaacgtaatgaatttacccttcattttatcttcctttcaatctttaaatcaaaaacaattcacactaaattataccatatgtgtggttttgttacaatttaatagtttttttagcactctatacttgacagtgctaaaaaatgtattataatataagtgtaatccaaaggaagtatcgattacatgaagtaatttcaattttgtattattaacaaaggagatggtttatatgaaattactacctggttttgctacttttgatgatgtttttgaaaatatgtttagtgatccttttttcaaaggaacaagtactcatatgcgaacagatgtaaaagaagtagacgataattatgtacttgatatggagttacctggttttgataaaaaagatatctccatcgaactaaaagatggttatttaaatattacagctaataaatctactgatggaaaggaaactgataatcaaggaaatatcattcgtcaagaacgttttactggtacttgttcaagaagtttctacattggggatgaagttaaacaagaagatatccgagctagttatgataatggtgagttaaagattacattacctaaaaaagctccaaaagaaattacaacaaacacatatattcctattgaataaaaaatccggttcccggattttttataataatgagatgatataaattacaataattcctggtaaggataacattgagagtacaaatatattaataaagttatagctaaaataattatttgttaaaatatttaaaatcaataaaattacaaaagctcgagtaattacaaataaaactctacgcataaaaagacacctcatataaatatatgaggcgtttatattttctttcttccttctaacgattttaacaatgttaattcatcagcatagtcaatattacttcctattggtaatccgttagcgattctactagtattaatattcttttttgataataatttagctaaatataaagctgtagtttctccatcacgagttggattggtcgcaataattacttctttaatcgagtcgtctaaacgctcaaataaacttgcaatatttaaatcatccattgttttaccatccattattgacatagcgccatgtaagacatgatataagccatgatattcttttactttttccatcgcaaaaacatccttaggatcctcaacaatacaaatagtcgtctgatcacggtctggatcttgacaaatatcacaaatttcaccttcacatatatgaccacattttttgcaataatgaattttggtttgaatactgccaattgctgcagaaaattcatctacatattttttatccattgataaaacatgatatgctaatcgttctgcactttttccaccaatacctggcaaacgcttaaaacaatcaactaaatcttggaatgcttggggataattcatcgtaacctccttttattcttcaaactcaaccaaatcaccaaataactcaaccgccatagcttgagcatcatttagttcagctctcttttctttaaattcaccaatatgatgtaaaacaattggctcaggtgcgggtaatgttcccgcccgattcatatcaatatactttgagcgcatatctggccaaagtgaatttttaattgcaataaaatcataattttcaccaagaacctcttttaaaaaattctttaactgataataattttgagtttcattcacctcattaacatttggttgatgctcaaaagctacaattattcctcctggggcagcagcaactggcttaccatcacataacattgaggcaaatttagcagtatttaaattgaatcgatatctagcaataactgtccatttttctttaatatcatttaaaacccggcgatcagcttgaactaaaatatttaaaatatcactaaaagacacctcaatattttctggtgatttatttacaataatattctcatcaatttcctgggaaatatcttccccaacaggcaaagaaacatcactattacttataactgtttccagagttccctcagcaacttcttcaggaaccaccgtttctgtaatatcatcagccttagcttttaattcttcaggaatactttcttcaatttccggatcatattcaataacccctttatttaactcttcctcgataatctcatcttcaattacttcttctggaagtgaatctgtttcctcaaccacaggtatcgctttagcagtatcttttacaggtaaaatatttacctgttcaattgctttagaattatcaattgctaatttattttcttctttaatacgattacatattttaagcatagccaattcaaaatatgtattagcatctaaagattgactgtaatgactgctagcttcaattaatatatcaataatttcaaaagcttcttctaccaaaatatacggtgccaaattatcaacatcttgctgtgttaaaacgaataaaattgaaacatcttgagtatttttataaatgataatatcctttaatacatcaactaaatcaaaagtaagccgcttaatatcgatactgccacttaacatattatcaagggaagtcaaaaccccttttatatctttagataacaattgtttaataaatgaaattttattatccattgatagcaagccatataccatattaacactttcaaccgtcaactcattattatacgccaaacattgttcaagtatacttaaagcatcccgcattccaccttcagctaatttagcaacactttcaagtgcagataattcatattttttattttcagattttaagacatattccaatcttgaaataatatcatggttttctactttcttaaaatcaaatcgttgacatctagaaataattgttggcaagattttatgcggttctgtagttgctaaaacaaaaacaatatgagctggtggttcttctaaagtttttaatagcgcattaaaagcaccagttgacatcatatgaacctcatcaataatatatactttgtatttaccattaattggtgcatattttactttatcaatcaagtctcgaacttcatcaaccccattattgctcgcagcatcaatttcaataacatcaggatgttccccaacagtaatagccttacaattaggacattgatcacatggaggattttcaccagtacaatttaatgctttggctaaaagtttagctactgttgttttccctgttccacgtggtccggcaaataaataagcatgtgaaattctattttctttaatagcatttttcaaagttgttacaatatgttcttgaccggcaacttctccaaatgtttggggccgatatgaccgatataaagctttatatgacatcactaatcactcctcattcttatttattatactatattatctaataaaaaggataaaagaattaacttttatcccgcttacgtttgtttttaaaataatcctttatcacttttgagcatttatctcctaataccccggagacaatcacgggctgatgattaacaggaatatccgattgataaatcgtagttagggctaaccagcgtgattcaaaagcaccaaatacaactcgctgaattcgactattaattatagcaccagagcacattacacaaggttcaagagtcacatataatgtacactcatcaagataccatgagtttaatgttcgacaggcttcttcaattgctattatctcagcatgtgccgttgctcttttactggtttcacgaagattgcgtccacatgcaataatctttccatctttaactatcactgctcctactggcacttcatccatatctaaacattttaaagcctcttgatatgcaatttccataaattcaagatcttgatccatgactttctcctttatacaaaaaaccactacacatagacggggattcttaatgctgctaccttccggtcctgacatggttcgaagccgcctattgtaatggcaagtatgattataccgtatctatataataaattcaatcatttttaatattgaatctataaaattattttcaatttacaacataccttaaaaatattgatcactaatataaattataaatttctcactacattttaatcactattttttctaaaccataattaaccataaataaaatttattttggtacaattataactaattctaacgatagttattttctatactaacaactgtagtcaggatagttttaaatagttttttcaatcctttctctaattgactactcttcatgatatcctttccctgatatcaatataaaaacagatagttttccctctatctgaatgatagaaacaagtagctttccctctacttgtttttattttaaatataaattcattaaataagtatcataatattttaaatacacatatatttgtcatatgttctgatgatttcaaagtctaatttattagataatcgtaccgctttatcattgttaattacttaataccaataatcctttaacactgataatactttcattccttcaagtgaatgatcaccaattattttactatcgtcttcaacaagtaatattaatgaattcaaataattttttcaattttatctgtttcattaaaatcaaactcaacaattacaaaatttacatgtttactctcgctatgacaattagagtaaataaaaaacaaatagagttattgccctatttgtttcttataaatataaattcataagataagcatccacataatgatcatcgattttcataaaattttcatatgttccgattacctcaaaaccatacttttgatataaagcaatagcattttcattactcgtaacaacttctaattcgataatttcaatacttgcttcagcagcatatccaattataatagcgactaacttactacctattccttgatgccaataactttttaaaacacttacacccatttgcgctcgatggcttaatcgtgtcttttgattaccacttagtgtggcaattccaacaatttcatcgccatctttggcaactatcattacggaattaggatcttcgtgaatttccttgattaactgcatctcctgtacttcattcaaaatacattcattcaaaccaaaagttaagttatcactttggccagctaccacattcaaataattaattattttcaatgcatcactaggtactgcctctaaatattcaatttccattcaatcaccttcttgtaagatgattatagcatatttacttctttaaacgtatctttgtgacaatttgtgtagcaagatataccaataaagtaaagccgaagataattagcatatcaattaaaataggtttaattgatccaaaactaaaatcagttaatttaataatttcattatttgctttaataaaccaatatgatggtaaaaattttgctaaacttaaaacaaaaggacttaacatactttgtggtacaaatgctccacaaataaaactcgaacccataccaaagagatttcctacaccacttaaaatttctcgattacttgtaaatttagcaatcataaaactaaacgcttgaataaatatcattagaactagtgaattaagtactaaaaataatccattcattgtcaacatcgcatctttataaagaataaaactgaatcccacatataatagccagatagctaatccaactgtataattacctaacattagctgacgattcatacttttataactaactggtgaaactaaattacgccgtttgatcttttcttcattgaaagaaaccatgatcattgtcacaattaccattgttattgttattaacatataattagagaaattataataagttgccggcattgtaaaatcaacctcattttgtttatctaacatccccacttcaacttttttatttaaatcttctttaattaacttacttaactcagtatcactaattcctgcttttaaatataaattagctgtatttaaatatttattcaaaagattcttactataaatactactatatgcatctggcaattccattgtttcaatagttacatctttaccattaataaaatcagtagtgtaattatctggaatgatcataatataatcaactgtacgataaaataacgcatcacgtaaagattcattatcatcttctaaactaattaattcgccatgatctttaatataatctttaaaaccattaattaattccgtatttttatcccgatttataatagcgactttaacatccatacttttatagtcagtagaagtagaattataagttcccgtaaaaattgctaacccaaggaagatagcagtatatgccaaaatcataagtgtataagtattagcaatttttagatattttttaaatactgtcatattgcttcctccttgtaaagaatagtgatcctaagattagaagaactccgattacaaataagcagatcatattagtagtataacgacttaaattatcataatagtataaagcatataacccatcagtaattaaacttactggattaatataagttaaaataggaagatttgtttgcatccagtatttaatatcaatgatcatcattcctgaaaagaatgataaaactagtgaaaaacttgataaaaatgatattttagtatcttcttttttaaacttaagaacatttccagcaaaatttcctaatcctactccagtaaaacatccgattgcaatcaaaagaataatataacccgtctgttcaccaaaaccaacacctaatccaaagatcaggtaagccattaataccatcattattgcaaattgaataataaaggcagataagattcccgataaaaccgtaacgagttttgaaatcggtgatatagtaattcgagttccttgtctagatagatttgcttcaatttgactagttgttctaagtccacagaaactagcatttaaacagttcatcccaattaaagtataaaaatatactactgttaaatccgtgtttccaccaatattctgattttcaaaattatttttagataaattgactgtatttaaaatattagattgtaatgcacttggatttaatgttgctatattttcaacagtgctcattgtactgttatactcattaacaatactttccaaaattgtttcatcaattcctgtattatttaccactaactttatttcattactaacaacataataacccgtaattttttcatcttttaataactgctgggctttatctaaacttgtgatttgtaaatcaattaacttatcatcacctttttccaattcctgcaatgtttctttaaattgtgaattagcctgctcttcaacaagtgcaactttaactgtttcaaattcttcacttgctgttaaattagcaaatgctaggttaaagaaagtcgctagagcaagtggaaatactaacgtccaaaatattaccatcttgttcctaagcaatgttttaaattgatatttaaagaaatgatagaacattaatctctcaactcttttcctgttaattctaagaatacatcatttaatgtcggacgttcactaaataaactagtataattaacattgttttctcgaacataatcaattaacttacttaaattatcttctttcgtattataagatatatgaacagtattattttcaatctcaatattcattacacgatcactatttttaagctgctcaataaatgtttgattcattgattttaattcaatcgtaattctctccccaagagtaatcatattttttaattcatctttagttccagatgcaattactctccccttatcaataataataatttgattacatagctgctcaacttcttccatgtaatgggttgtataaactattgttgctcctaattcatttaatcgtttaattccctctaaaatattatttctactttgtggatcaactgcaactgttggctcatctaaaaaaattaattttggcttatgcgctattccacatgcaatatttaatcttcgtaataatcccccacttaattgctttggtttaaatttagtaaattcgtttagactaacaagattaattgcatcttgaacatagttggcacgaatttttttatctttaatatataaaccacaaaaataatcaatattttcaataacgcttaattcatcaaatacagctacatcttgaaaaacaacaccaattttactttttatatcataagcagtaggactcatctctttattaaaaatcttgattgaaccagaatcatactttaataatgataagatcgtattgatagttgtcgatttaccactgccattaggtcctaataaccctaatatttccccttcataaacatctaaactaaagtcatctaaagcaattaaatcaccataacatttagtcaaattctttatctcaataactttattcatctttactcctccttacatcatcactatacgtaaaacttttatttcaaaccaccaattttagattgcagcatggtttcttttaagcaactattagttgcgatggcggtttctttttaatttttcatttatttttttagcatcttcattatttttcataaaaacgactgcttttacaaaaaaataaacagttactgacataaatgtaacacctataaaattatctaattcaataatactgtttgtatatccacataaataattagcagtacagactacaaaagctatttcgataattgaaagtaaattggttaaccactcctgtaattctaaataatgagttacatttatcaataagtttacgattacacaaacgataaaaatcatcacaactaattcattagacatattttgatgattgaaatgaaataataatgtttgcaataaaattacaaacgtatatgatacacaagtcgtcaacatataaaatttaaacatttttaatttattcatcttatcacctacattccaaatttttccttaaaactgcttacataatgacgtgtaataattaacctttcacgattaattaatagcgcttcataacgcccatttaatagagctcttacattatctaatttgtttaaatttagcaatattgatttactgattcttacaaacaatcggggatctaattgatcttctaattcatataatcttaggcttgtttcatagactttatcttcacaataaataaaagcacgatcttcatttgcttctaaataataaatatcatctattttaatttgataactacgattgtctaattttccaataataaaatgtttatcttcaaataaagaaataattcgcctcacttcatcatcaattttattacaacgaattactacttctaattcattatcttcctcacattcaatgagcaccttcatcgaatccctcctttattaacaccttatcatataatatcttttttacctatctaattttggtaagatgcacatagattagctaagatgcaaaaaaagaatgctaaaacattcttttgatatatctgaattttttcatcaaaaagatattgatagcccgaaataaatctaccaaccagcagagcagataacactgttcccataccaattccataaactggtatctgtaagactaaacaaagcaagagcatcataataatcatagtaatatcaaatacattttttactaacgaaaatttaagattatatacttgcgatatagtcttaaccgttgattcaacgggtgttgcaataagattacagctaactgaaaagtatactccaagtgaaacaaaaataattgcaatcagtaatagtagataagcagataataaatttgaacacctaattttaattaaagaatcataaaaatcggtaatatatccaaagattaatgaaaatggaatttctaaaaaaattgtaatagttaattttctaactaaacaaatctgaacaataattaaaatcaaatataaaataattgaagcagttcctaatgaaatattgttgaccttactaaaagcataaaaaagactagtgaacgcagcacccccaaatcagtgcgggtattcaaaattattcccaaagccaaaatattgattgatagtatgtagatgattcaacgattaacatttttattcatttatattcctcaatcaccaagatagtaatatattaatcaataactttctaatattaaaaagatattatataataattaaaagttattaaaggggaatatgaaatgaatcttaatcaaataaattattttttagcaatttgtaagacaatgaattttactaaagcagcacataatctatatatcgcaaactgcagttacaaaacagatacaattattagaaactgaattaggaactaaattatttaatcgcgataataaacaaatagaactgaccgaagctggtagattttttttaattgaagctaaaaaataattaatcaatttaatcattcaaaattaaatattgattctttcttaaaaggacaacaaggtacaattaaaattggttttcttaaaaatttagatcctcaattattggttactatattttctgattttataaacgaatttcctaatataaaaatagaattaacaagctatgcaaattatcaattatatcatgcgcttgaacaaaggatgatagatatagtcctaggattatcatttcctaaatatcctgactatcaaaaaatattaataaaaaaatatcctttaatagtattaataaataaaaataaccccttagctaatcaaaaaactgttagccaagaggagcttccaaatattttatttgatgttagaaaattatactatcaagataattatcctgaatttgaagggaatttattaaagattgcctgtaatcaaggttgcgcaattttgcatgcctttacaaaagataattgctataacgattatcttaaagctattcccttaacaccattaagtgaaaaaagtgtttatctaatctatgatcaagataattataatccactgatcagtaattttattaattatttaaaaactacttcgatattaaatcataaaaactattttttatcttactgatttatttagtgtttataacatgctccttaagccagtgagcaacaccatcttcatcattacttttgataactgctgtagcttgttgttttaaagaggttactgcattagccattgcataacattgatcagatattgcaaacattggcaaatcgttgattgcatcaccaaaactaactatcctgtcacagtttaaaagttctttcaactttaaaatagcacttgctttagaggcacttttaggcataatttctagccagtattctttacgatatatttcttgttgaaaagtaatattataatctaaatcatcctttaaactttcataagctggtcgaagattatcataatctccaattatggtaaaatagaaaacttcaccctcatacaaagataagtaatctaatgttaaattaattcgataatcggttttacgcttactaagataatattttaccccttcatgaaggctttcatttattatcgttactcgttctttttcatttactagtgcatataccataggttttaattggtttttttccattattgcttttatatgcgctacttgttttgaattaaaaatattcttatgaagcagttttccagtttcgccattgacaataaatgtaccattatagattatcaaaggaagatttttgattaatcctcttgttactggtgaagcggaaactagagaacgagcagtagcatatgtaaaaatcattccctcattaattaagttattaattgttttaatactgtaatcactaatttttccttggctattcaatagcgttccatctaaatcacttatataaagagttttcatatagataaaaagataactatttagttatcttttccttacctcccatatatggttgtagtgctttaggaatatttacactgccatcttcatttaagttattttcaaggaaagcaatcaacattcttggtggtgcaactactgtattatttaaagtatgagcaaaatattttccattttcaccattaattctaatatttaatcttcttgcttgagcgtcagttagatttgaacatgaaccaacttcaaaatatttcttttgtcttggtgaccaagcttcaacatcaatacttttagatttcaaatcagctagatctccagaacaacattctaaagttcttactggtatatctaatgatctaaataaatcaacagtattattccatagtttttcaaaccacatcttactgtcttcaggtttacatacaacaatcatttcttgtttttcaaattggtgaattcgatatactccacgctcctctattccatgagcccctttttcttttctaaaacatggtgaatatgaagtatacgtatatggtaatttatcttcttctaaaatgttatcaataaatttaccaatcattgagtgttcagaagtaccaatcaaatataaatcttccccttcaattttatacatcatgctatccatttcttcaaaactcataacaccagtaactacattactacgaatcatatatggcggaataacatatgtaaagccacgatcaatcataaaatcacgagcatatgataaaattgcagaatgtaaacgagcaatatcacccattaaataataaaaaccttgtccagcaactctcccagctgcatccatatcaataccatcaaaattttccattatttcagtatgataaggtatttcaaaatctggtacgactggttccccatatttagtaatttcaacattctcactatcatcttttcctaatggaacggattcatcgataaaattaggaattttcatcataattgcttttaactcactaccatattgagtttctaagtcttctaatttagctaattcatctgccattgcacttacttgtttcttattattttcagccgcatctttatttccttcacgcataaattgaccaatttctttagataatttattacgtttacttctcaattcactagctttagttaaaacttctcgataatctttatctaatttgtaagcctcatctactaatccaatcttgtcatcttgaaatttctttttcatgttttctttaactaaggttggattttctcttaatatcgcaatatcaatcattttaattctcccttgcttatatatattctttaaaattatacaataattatgcaccttattcaattattatcaagatgtttctcttttaatcatttgcttttagactagaaaccatgtcgatatgttttatccttaatgaaataattttacttattacccaggaaataactaaagtgcctaaaattgcatataagtaagaaggtaaagcaatgaaattaattacatccattgtatcttgaatcgttgatatcatgtattcaatcaataaatatcctacaggcaaacctaataaaattcctatcattgataaccatatgttttgttgaaccaagattttttgaatctgagtatctttaaatcctaatacttttgatgtagaaaattcataataacgttctaagtaagacagtactcctaaattatataaaataactccacctaaaataattgcacctaaaactagaataataataattaggatcattgcctctaataaaacatcaaaactttctaataagtcctgctgatactgaatcaaaaaaatatttgttagattggtcaagcaatcttgatttttactcccaatgattgcagtgggatagtattgatgaccagtttgcaaatattcttctttcataatcgtaattccttggatattcggggttctaataattaaagatattttagattgatattcttgatgatctaaatttcctttccacttaattatatctcctacctttaaatcaagcttatcggctgttttttttgataatgcaattccttcttttaaagatttaaaattacttaaatcttgagcaagtttgatataatcattattttccaagactgttaacgaaacatctaaattttgttcatcaattactattttagctgtactctctaataatgtctgtcctttagtctggtttaaaagataatcaatttgctcttcattaagattatcatttaaattaagtttatatttataattttgtaatttagtataattccaatcggtcaaattagtcattgtatcatataggccacaagcactaaataataatgcagtgcagcccaaaactccaaaaatagtcataagactccgtaatttatttcgaataatatcacgaatattccattgaaatcgaaatggtagattactgctccatgctagtgaataacttgaattactaattaaattattgctataaagaattgttgcaccattcatttttaaatatttgaaacagacagaaaaactaattaacatgcataatatagtacagccaattggtaataaatatcctaaaactattggttggctagttaaaaccggtaaaacatacatttcttcaaacattggataaatcaaagctggcattattattaaaccaagccagtaacctaatattgaaccaactaaacaaataaatgttgaatgtgataaataatggatcagtagttttcttttcttaaaacctaatgcttttaaaattcctaactgcattcgttgactttgcaaaacccgatgcattgttgtaatcgtaattaaaacagcaataaataaaaaagctaatgaaaaaaccaaacctatcgagcgatgctgggcaatctctccagtcaacatatttacactaggatgatctttttggagaattagcttgtattcattaccagctaataattgatcaactattttactaatgtctttttttgaggaaaggactagttgattcggatggtataaagtgttaggaaaactattattatttacatatgcaaaaccatatttttgacgatttggtgtcagttgatctcctttagccaaatagatattttcaggggaataaactaaaccaataattttcttacttaattcaaaattctgatattttaaagttatttgatcatttaaccgataaccatttttcttagcatacattgcatcaagccagataccatcatcttgattattaaatgatttaccattaacgactttaagagttgaaattttattactatcagtaatatagagatcaatattactattatcaaccgctttattgcttgtagagacatacattctttgttcataatcagtctgtttttttagttcattaagagtcgaatcactaaattccttttggtaaagccaagcatcagctaaattattctctttaatatagttatttaaagctacttcaagtccatgatattcactagatatacctgaaaagataaaaacacctaaaaacatcataataaatatagctccaaactgaaccttatttttccataaatctcgaatcatttttttaaacaacatttaccattccacctccatcacatcaagaggatgagaatttgttgtaattgtattgatttgaccattttttactcgaattactttgtcagcgatagcttgcaaattagtattgtgggtaacaatgatagttgttttatgatattctttacacatatcatgtaataacttcaatacttttgctcccgtatcactatctaaagctcccgtcggctcatcacataaaagaatctctggatttttgaccactgctcgagcaattgaaactcgctgttgttctcccccagataactgatgaggaaattttttcttatgcactaatagtcctacttgatctaaaacgttatcaactggcataatatctttttttagttccttcatcaaggctacattttcataaaccgtcagtgttggaattaaattataaaattgaaatataaatcctacttgatgagctcgataatctgataattcattttcatttttattcgaaattacttcattatcaataattatttttccttcatcaagacgatcaattccccctaaaatatttaataaagtacttttccctgccccactcggtcctaagataatgacaaattcacctttattaatagtaaaagaaaccttatttaaagcataaatttttttatttccattttgataaatctttgatacttcttcaaatttaatcatattttctccttttttgcataataaaaacatgtattcaaaagacaatgaatcatcactgcaagtttttatttctcttcgttaacaacaatgcctgtacacaacattttgaaaacttttaaaaattcttgtttttgcatttcaagattatcatgacttactaatacatgcttaatacaatcaataaacatatttgtaataatatcaatatacggcgaattgatatcttcaatattaagatgccatgccatatgttacttaaattttaaaagaaaccaatcccttttttctttatattccgtcgtttttaattcaaaaaggataattaatcgttcatccattatatatcgaaaatcactttcttcaaaaaaatctccaaattgatcaagtgcttcatcaacctcttctagtgaatgaacttgaatttcttcatttagatgaacctcaactaacttatttaatgacttaattgatggctctaatacagctcctaataattcttctttattagtaaaataattatataaatttcccaaggtggtatgtgatttactagcaattattctcattgaagccccttcgtagccatgatgcaaaaattccactttagcagcttcaataatatcattctttaaatcttctttttttatctgcatcttctcaccccacaacaacatcatacgtgatattaatagctaaaacaatcatcaaagctcattaaaaatcattagttaacaaccgttcattattaaaataagggcctaaataatttagcccttattttttcctattcttttttattaaaaaattgatcaaaatttttagccataattatagccatatctgaattagtatcctttactcttatcataagatcaaataaattatattcacccgttttaattcgacaatgtaatttatcatgggctgttttctgtcccgctcttattgaagtgagcatatttaaatatttattctgatcttcaggtaaaataagcgcatcttctaataatttttcaggaactatttttgctcctttaggtaaatcaatactaaatttatcatccatatataaactatccatccgattatttctaacatcaaaattccaaacatcaacagccaacactgataaaataaaattataacgatcttttaatttttccgcacgttcttgttgttctttaagagtattaatattagtgataattccatgataaatgattgttccatcttcttcttgacgataaaagtttgcattgatattatgccaactgactttaccatttttataatatgagcgataatcaaaatttacacaacttttttgtttagataattctataaattgtttagctaaaacttctcgatcatcttcataaactaaatcaaatcctttattatgtttcagtatatctgttaactcagattgttcaaaatcaaatattttagataatccatgactaaggaatttagtggtaatatgatcatcttttattttaataacgacaatatcccctggggtattttcaataacaatatttaaattatcttccatctcattacagtgttgttctagcatcatttgttgatgatcaacagtgctatcgatacaaaaaacatcagctactaattttccattttctctgtgaatattagaaaaatagatcgttagccaaatcttttgtgcagttttggaatttacttcaacttcaaaataatcgattttaccagctttaatctgttcaattacatgattacataaaaaataagcttctttactaactatctgacttaaatcattattgattggcggttgattaaaatcagtacgagtatacccaatcgttttataaaaaccatctgatgcaaataaaattgttcctttgccatcaagtgtcattttaccaattccaccgttaatattttttaataaactatttatattttcttgtaattcatgtgattttaattcattcactttttcatttgtaacatcataaaaacaacataaataatatgaaccccactctggactatcaactaatcccccatacatattaatatacacggttttaccatttttagctttaattttaaactcaactaaatttttagaagaacgatcagctaatccattatgatagaaaacatgtttaaattcttcttcgctataaaacaactttttaggccattcaattcctccacttagcaattcttctcgactataaccacttaattcaaccaaactatcacttacaaatagtagttctaattcataactgaatccagccaccccaccaggaataaaattaaagatagaattagtaatagctttgatttcactttgagaaatattgtcaacagaagtatatttaaaatcatctttattccatggtaaattaaatttaccgtccgtttcatcaatcattttttcaaattctactgtgctgactggctttgaaaaataataaccttgaactacattacatccaaaacgtttcatatataaacattgatccaatgtttcaactccttcacaaataattgttgtctgtaacttattacaaatatcaacgattgcaggaataataatattattgcgattattatttgactctcttttagttatatatgaacgatccaatttaacaatatcaaaatttagatcttgccaaatattcatccctgagtaacctgttccataatcatcaatcgaaacacgataaccaaaacttcgtaattcatcagctacttctctcaccttggttaaattcttcaaaataaccgtttctgttaattcaaattccaataaatatggaggaatattatatttattaacaattttattaaccctagcaacaaaaccagtttcataaacatgcattcttgacatattcattgatacaggaattagttttttgccttgatcaattctttctcgaagatacctgcatacttgctgacaaataagaaaatctaagtcaattattgtttcgtttttctccattatttcaataaattgatcaggataaataactttattatctttaataaggcgggctaatgcttcacttccaacaatttttcccgtattaatattaactttaggttgaagatagaatgtaaataatttattacgtaaagcattttgaatctcaatttctaatattttacgtttattaataaatttctgcatatcttcattaaaccaaactagtttacaatgattatcttttttagcttcttttcgtgctatattagcttgatcaattgctttaatgatagctttttcttctaatttaactggacacaatcctgctgctacagcaatctttgaatccgggtgatgttcttcttgcgatgaaataaaagtttctaatttttgttcataattccttgttacagattcaatatcacaattatcttcaaataaagatagtcttaaaaaatgatctgaaaaaacacgtccacataaaattgtccgtggagacatacttaaaaatttagcaaattctaaaagaaaacgatccccttcaataaaaccataaaagtcattaactaattgaaaattagttaaatcagcgtacataattacataatttttactattcttattactttcgataatatcagtcgcctgtttaacaaattcagtataatcgtttaaataaaaattatgactttcttccattttaacaccacctttctggtcacactctattttcattatatcaaatataaccgttatttaatataattataaaataaagtataaagaaaaaggacatttagtccttctttgctttaaaattataaaaatatttggttataaaaataaatatgaataaggcaattattgcaatcacaaatgtcaatacaacatttgtagtaaaaccagcaactaaatatccaacaacacaagctccagcaactagcattgcgtaaggtatctgagaagtgacgtgattaacatgattacattgagctccggccgaagccatgatcgtcgtatcagaaattggtgaaatatgatcgccacagactgcccctgctaaaatagatgcaatcgcaattacaagcatttgtgaaccttcggggaaaatcgaagtcgcgataggaattaaaattccaaaagttccccatgaagtccccgttgcaaatgctagacctgttccaactaaaaataaacaaaccggtaaaattgctgtagagatactagctccctgcattaaattataaacaaagaccccagcttgtaatttatctgacactaaatcccctaaagtccatgctaaagtaagtataatcatcgctggaaccatcgttttgaatcccattggtatacatttagcaaaatcttcataactaataatctttctaggaagatacaaaataaagataaatactagtgtaaaaaatgatcccaagaccagtcctcttgaagcatcgcagttagtaaaagccgtaatgaatgatactccttcaaagaaaccacctgtgtataacattcccacaatacaactaatgattaagaaaaaaactggcaataatagatcataaacccgcccttgatcagaaacttccatttcttctccttcttcataatcatttacaccattatgcacatcaccattttgagcagctatttcatgatgtttcattgttccaatatgaaaatctttcttaataacataagtcaccattacgattgttaataaagcatacaagttaaagggaattgtttgtaagaataaactaaaaccatcaccacttgtataaccacttacagcagccgcccaactagaaattggagcaataatacagattggagccgcagtactatcaataatataagctaattttgctcttgaaacactaaattcatctgttacttcacgcattacacttccaactgttaaacaattaaaataatcatctacaaagattaaaattcctaacaagaaggttgaaaatagtgagccttgtcttgattttattttttcttttgcccaaagtccatatgctctacttccacccgctttagtcatcaatgtaactataattcctaaaaatattaagaatattaaaataccgatattccatgtatcacttaaacttccaatcattgtatcaaacataacattaacagtatcaataatatgaaagttacttaacagtaaagcccccgaaacaattccaaaaaataatgataaataaacttctttagtttttaatgcaattaaaattgcaatgaccggtggcaataacgcccaccctgtttgtacaaaatccatcttttcctccataaaaaaatactttaattggcaacaatcaaagtacttatatactaagatagcgctccacatgaatgtgacaggaaattatatcttctataatcccccaggtaaatagtaattggtgttactatttccttcggcaaatcaccctttcgcaaatgctgtcaccaaacattacattttgctactattgatcattgcacctctaccaattatttaattttatcctccatgagtttatcaaagcaattcgttcttgtcaataaaattgttctaaagtgagaacattttatatttatttaactattgacaggaacgtaacgtcacttgctagaatgaaaaagcaagggaggtgttatttatcgaatacacatataatcaattttgtcccaatgccaagatactagatatttggtgtggtgatggaactatttggttaaataatcaaaataaaatttctaataatatttcgattactttagctgatatttctctgaaaatgcttgaagaatgtcaaaacaatactcaacatttaccccaaattaaaacaattgaagaagctgattgttattatttaccatatcttgataaaagttttgatgtcgttatagcaaatcatgttttcatgtattctgacgacttaccaaaaacattacaagaaatcaatcgtattttaaaagatgatggaattctctaatgttcaactattgctaaagatatgatgaaagaaagagatgttatgttaaaagattttgattcaaaaatctcatttaatcaagaaattttatatcaacgctttggttatgaaaatggtaaaacaaaattagaaaaatattttcaagatataaaattatatgatcgaaaagaggtttatgaaataactgacttggatctttattatcaatttattttaagtggtaaaggtctaagtcttaatcttgagccactatataaaaagaaaaaacaactatatgaatatatgcaaaaatatttaaataaaaataatcttttttatttgactacccatgccggaatgtttgttgcaagaaagaggaaaaaatgaagataattggtagtgattttgacggtacaattactacaaataaagtaattctacctgaaactagaaaacaaattaaacaatttagagatgctggtaacatctttattatcgtaaccgaaagaagtcctcagaaattcaaagatggtattaagaaatatgatattgatttctttgattatgtcatttgtgctaatggagctgttacattagatcaacaactaaaagtaataataaaataataacggcaaatacgatgtcccagagtattgtaatcaataacctagaagatttagaaaatataagaaatgaaattatttcgtttgccttagaatttgattctattgcccaaagaaagcagtatacatttgaccaaattgaaaatattaatgtctttcataattcccgctatactgatattttagctaaagatatttctaaagcatctgaattattaaaacttttctatcaattaaaagctgagcaactttatacaattggagatggtgaaaatgatatttgtatgctgcaatgtactgataacagttttacttttaatcatgttgaaacagttattaaaaatagtgcacagtatcattttgatataatagaacaaatattagcttttattaatcaaaaataactctcacaattaagtgagagttattttatattccaaattcttttgcatatttaacttcgccactaattttaccagctctaaatatcagtttttttgccataaaattaattgaaggaattcccttaggcactttgattccaaactgttcagctggtaaatatccaaatcgtgaataatagtgctcactacctaaaactaaacaatattcatatcctaattctttagcaatttgatgacctttgttaattaaagcactaccaatcccttgtttttgaaatgctggtaaaatagctaatggtgctaaaactaatactgtatcatttccaacttttgctgttgtaaacataatataaccaacgagctgattatcaattttagcaactaatgataatttttgaatataattattaccagtccttaaagctataactaaatcttgttcatttccatcactatgttcagctgttgcaaaagcggcttttactacagtatatatttcattaaaatcttgtttttcttctggtcttataatcattttattttcctttttcaaagaattaaaagtatcgctaagcgatacttttaattctattcttcttcagatttatcttcttctgtttcagcagctttttcaactacctctactgaagataccttgttttctgcatttactttaattaaacgtactccttgtgtagctcgaccggctgttttaacttgttccattggtaaacgaatcatgattccatcgtcagtaatgattaataaatcttcatcgccattaacagcacgcaatgcaacgatttgaccatttcgctctgttgcattaatagttttaacccctttaccgccacgatttgacaaacgatactcttctaatggcgacatcttaccataaccacgttctgtcacaaccatgatatatttaccttctttatcagttgtcattccgataacttcgctaccatcaacattgattcctttaaccccactagcacttcgtcccattggccgaacattagtttcttcaaaacgaactaatttaccgttagaggcggcgattaagatttgatcattaccacctgttaatttaaccgaaactaattgatcatcatctcttaagcttatcgcaatctttccagattgacgaattcgttcaaattcattgatgtgaactcgttttactaaaccgctagcagttacaaagaataaataataatcattattttcttcaatttgcttacgattaatactaatcatcgatttaacttgttcttctttatcaagatttaataaatttacaacaggtaaacctttagccgaacgtccaaactctggaatattatatccttttaaacgatatactttaccaaaatttgtaaagaataatagatcatcatgagtcgacatattaattaacgaacttacaatatcatcgctattagttgccattcccttgattcctcgtccaccacggttttgtgttttgtatgtatctactggcattctcttaacatatccattattagttaaagaaataataacgtcttctactggaattaaatcttcgtcttctaaatcaaatgttccttgaataatttccgtacggcgtttatcaccatatttatctttaatttcttctaattcatcatgaatgatcgataataaacgttctctattttctaggatatcttttaaatcagcaataatttctaataatttatttaaatcatcttcaattttttgtctttccaaaccagctagacgttgtaattgcatttctcgaattgctttagcttgtttatcagacatattaaattcttccatcaatctagtttgaatgatttcagtagtacgacttgatctaattaaatcaataatagcatcaatttgatcaagagctctttttaatccttctaaaatatgagctcggtcttcagctttagttaatctgaatttagtacgtcgtttaattacttcttcttgatgatcaaggtataaagtaatcatttcctttagatttaatgtttttggttcattattgaccaaggcaatgcagttagccccgaaggttgtctgcaatgatgttaatttatataattgattcaaaattacttctggttgaatatctcgacgtaattcaattacaactcggataccatcgcgatttgattcatcacgtatttctgtaattccttcaattttcttttcccgaactaactgtgacattttttcaatcatccgagctttattgaccatataaggaatttcagtaacaacaataacttttttacttcctttttcttcaatttccgtctttgctcgcatgacaattagaccatttcctgtctcataggcttttttaattgctgttttacctaaaatataaccaccagttggaaaatcaggaccttgaatataattttccattaattccatgattgtgatatccggatcttttgcaactgctaaaattgcttcaatcacttctactaagttatgaggtggaatattagtagccatcccaactgcaatccccgttgaaccattaattagtaagttgggaatacgagccggtaaaaccgccggttcctgttcttcaccatcatagtttggaataaaatcaattgtatcttcctttaaatcacgaaccagctcactagatatttttgacattcttgcctcagtataacgttgtgctgctgctccatcaccatcgattgagccaaaattcccatgaccatcaactaacatataacgatatgagaaatcttgagccattctaactaaagcttcatatattgaagagtcaccatgaggatgatatttccccataacttctccgacaatacgggcagatttcttatatggtgtacctggagtacatcccaaatcactcatcccgtaaataattcttctttgaactggttttaacccatctcgaacatcaggtaaagctcttgatacgataactgacatcgcatactgcataaaagagtttttcatttcagatgttagttttacttttctaattccccgttcttccattatttatctcctttatcttaaatatctaaatcagtaacgtatttagcgttttcttgaataaattcacgtcttggttcaactttttcacccattaacatatcaaaaatcatatccgcttccattgcttcgtctaaatcaatttgatttaaaattcgtttttcaggatccatcgttgtttcccaaagttgttctgcattcatttctccaagacctttataacgttgaatactatatttagcaccttcaccaatcttagttttcaaatcatctagttcttcatcactataacaataatattcatctttaccatgtttcaataaataaagtggtggttgagccgcataaacaaacccaccttcaactaacggtcttaaataacgatacaagaatgttaacattaagattctgatgtgcccaccatcaacatcggcatcggtcataattacaattttatgatatcttaatttatctagattaaactcttctccgattcctgtaccaaacgctgtaatcatagaacgaatttcagcatttccaaggattttttctaatctcgatttttcaacatttaaaatttttccacgtaatggtagaattgcctgaattcgacgatcacgtcccattttggcactccccccagcggaatccccttcgacaataaagatttcacattcactagcatctttacttgaacagtcagctaatttacctggcaagtttgaaacttcaagaacattttttcttcttgtcatttctcgagcttttttagctgccattcttgctcttgctgcaacaatagctttatcaacaataatcttagctgtatcaggattttctaataaaaatttatctaatgatgcgctaataatattgctggcaatttttcgaacttcagcgttacctaattttgttttagtttgtccttcatattggggatcaggatgtttaaccgaaataatcgctgttaaaccttcacgaacatcgtcaccagataaagcttcttcatctttctttagcagtcctttacttttagcataattattaataactcgtgttaaagctaaacggaaaccttcttcatgagttcccccttcatgagtattgatattattacagaaggaataaatatttgattgataaccatcattatattgcattcctacttcaattgtaatttcttgctgcatatcttcaacatagattatttcttcatgaatcggtgttttatttttattaatataggcaacatattctttaattccgccctcataataatattcatgttttcgatccacaccgttacgttgatcttctaacgataaacgtaatcccttatttaaaaatgctaactctctaattctttgtctgagtgtatcataatcataaacagtaccctctttaaaaattattttatcagccttaaaagtaacaattgttcctgttatatcagagtcaccaataatctttaattcacctgctggtttcccaccattttcaaaacgctgataatattcatgtccatcacgatgaacatttacttctaaccattctgaaagcgcatttacaactgaggctccaaccccatgaagtccaccagatactttgtatccgccaccaccaaattttccaccagcatgtaatactgtaaaaattgtttcaactgttgagattccagtcttagcatgagtaccggttggcattcctcgaccgtcatcaattacttgaacaacatcatcatcctttaaaattacgcgaatatgactagcatatccagctaatgcctcgtcaatcgagttatcaacaatttcccaaactaaatgatgtaatcccctaattgaagttgtcccaatatacattcctggtcttttacgaaccgcttcaagtccttctaagacttgaatatcggattcatcataactatgttctactttttcttctgacattatgtagcctccttgccacccttaatatagattttttttgccttttcaacaatttgatgattaattccatcaattgaagttgttgtaataaaagtttgaattttctgattcaaaatatctaataacatatttttacgcgcttcatctaactcagataaaacatcgtctaatagtaaaacaggatattctcctatttcatctttaatcaattcaatcaacgcaatctttagacttaatacaatcgttctttgttgcccctgtgaagcaaataaatctgcagcattgccattcataaagattttcaaatcatctttatgaattcctaaatgactttgcatatatcgaatatctcgctgatgattttttttatataatgctaaaatattttcatacgttaactcttgtttaaggaaacaactgtatcgtaagctaattttctcattatcatttttagcaattaaattataaatagaagttactttttgatttaaattcttaataaaatcaattctttttttaatcaactctacttgcaatcgtgccatctgttcgtcaagtacttctaaatattcatcaccatcacgattcttttgatttaaaatttttaaatacttatttctctccttaagtaaattattgtatttacttaaattaaaaacatagataggtgagatttttgataattctaaatcaataaaacgtcggcgattatttggactgcccttaattaaataaagatcatcaggaacaaaaactacgacatttaaaagaccaacatattcactaattttataaatatcctggtcatctattttcgcacgtttaaaatcactcccaagaatcatttctaaactacggagcttattattggaagtgacttcaccttttactttcgcaaattcgcaatcaaacataatcatctgcttatttatatgagttttaaaagattttcctactgacaataaataaatcgcttcgatcagattagttttaccttgtccattactgccaattaaaatattgatatcacgatcaaactcaataaaaaaatgattataattacgaaaattgtctagacataatgaattaactttcattaatcaataacaaaagactctccattaaattctatctggtcaccagttcgaagtttcttgcctcttcttgtttccacttcaccattaaccatcactaattcatctttaataaccatcttagcttcgattccactagaaacacatcctgcatactttaaaaactgtcctagggtaatatattcatctcttatttgaatttttttcatgactatcctctttttttataaaatctagagttattataacataaattgttgttaaaatcaaaaaaataagcattttaacgcattttttataaaaatgaataaaatcttattttttattaaaattcgctcatatttaaaatttatccacatataaataaaacaactagtaaaaaaatactttcacgaaaaaaaaagctacataatgtagcttagaaagttcttactggtaaaactaattgaattacatcatctttttcaaaatctttaataataaaaggtttcatttctccagtaaataaaattttaatttttggttcattaaaagctctaattgcatcagttgcatattttgaactaaatgagatacttattggtgttcctttataaaaagatttatctaaaatttcttctacagaaccgatttcttgcatatatgatgataggacgactttttcatcagacatatctaatttaataatattattttgttcatttgttagtaatgaaacacgatcaatagcatttaatagataatgagcatctaaatctagttcataatcaaaagcatcaggaattaaacgattagtatctgggaaagttccatcaattaatcgtgtttgaataatattattatcaaacacataaaggactttacgatcagaaacatacatttcaatcatttcatcacgttcaataatttttgaaatttcatctaaagatttttgaggaattgtaatattgaaagtaacgtcttcatctaaagatacaattttcttagctagacgatagctatccgttgctgtacattctaattgacgatttcctgctttaaagttgattcctgttaaaattggtttgtgctctttatcactagcagcaaatttggtctgtgaaataatatcttttaaagatagtgcatttaataatacttttgttccagtttttgataaatcaattcgtggataatctaaaacatcagtaccatttaagtcaaatttagaagttgctcccgaaattctagttaaagcaccatctaaaatctcaattttaatttcatcactatcaatcttacgaacaatatctaagatataacgagaatttaaaactaccccaccagtttgataaatcgttaaatcttcatctttttcaattttagtttgaattgtaatgtcagaatcactaccagttagaattaaacaatcgtcttgtaaatcaaacttaattccagtcaatactggtaagggacttcgaattgaaactgctttagttgctttagcaagagcatttaataatttaagtcgttttattttaaaattcataaatttcctccttgtgactaattatatataattatttaaaataatgctattaatattattatagtgtgaatattgtgcataagcattaaataagctgatataatcagtgttttttatgtgtataactatgtgtgcaatttgtggtagttttgtgtctaaacgatacctaatttgtcttttaacttatttattgctaatttgtagtcaggatctttcttgattttagtttctacgcgagcacatgctttcattactgttgaatgatctcgattgctaaaagtagccccaatttcagcaaaagtaatatctaataattcccgcattaaatacatacacatttctcttggggttgttaatttacgtgtcttgttttttgaaattagctgactgattgtcagataatagaattctgcagttgtttttaaaatactttctttagttagggaactctttggattttgaacaattttatcatctttaaaagattctaatgcaaaagccatatcaatattattagtatgattcataatgctacagaagaaaagacgttttaaagccccttcaagactacgaatatctttacaataatgattagccataaaatcaacaacatcatcttgaataattaaagaaggattatcaagattttctatctttttttctaagatagcgcgagctgtttcaaattctggcggatcaattccgaaacttaatcctgaattgaaacggctgattaaacgtgattcaattccttgtaattcttcaggcatcttatcacttgtaataacaatttgtttattattattaattaattcattaaaaatgtggaaaaatatctcgctgcttttttctttattgaataaaaattgaatatcatcaattaataaaatatcgagatttttatacttatcatagatttcatcaccatcacggcctttcattgccccaataacttcatcaacaaaatctttacttgtaatataacgaattctaagcgctggatttacttcttttgcataatttccaattgcatttaatagatgggtcttacctaatccaggattactataaataaacagtggattaaaattagaacccggattagtagatactaatagagctgcattttgtgccatgcgattagaacttcctacaacaaagttatcaaatgtcaaggtacgattcagattatctctaaatggcgtttcttgtttaacggcaacagattttttaaagtcttcttcaccaacgatttcaagattaattgatgaagctaacatcccagaaagaatatcttcaatgtctttttggttatttttaattgtttcaacattaaatgaaaatggggttgtaataataactttgttattgttaatggatgctatttttgcacttcgaaaaacagattccatgattactttatcgattttacgttcttctggcaaattttgtttttctaaagtgtcgaggcataattgccaaatcttactattatcgctcattttttaacctccgcaaacctcattataagttaataaaatgtaaatttaaaggataaaaacagttaaaaaagagtgttcacaaagttattcacaataattgttacatttccgtaggtttttattagaaattcacaatattcacaactttacttgtgcataaagatttatgtgaatgtgaaaaatgtggctatctagttatctagaaactactgttcataataaactcacaatagcatatttgttattccaagcactttgagagtttttcacatttattcacatagtaaaaaataagggtatgactttgtgcataagttgtgtgaagtttaggttaatttatgattaattagcaagattcgtcgagaaagaagtcacaaaataatgttactttttatcgaaaatcaagaaaatccttataaattaaggtttttttattcttaatagcaaaaagaaaagcacaatttaatgtgacttttgtacaatataaactattttaataaatctgaattaataaatttgtctaaaaagattttttaaaattcacattattttgtgagatttgtaaaatgttagattttcctaattatactttttcccgtaatttcattgacttaacgagctttttcatataaaatggtgaggcatatgttatttgtataaaagtataaaaaattttggaggtgtaattaatgaaaagaacatatcaaccaaataagagaaaaagatcaaaaactcatggttttagagctagaatggctactgtaggaggaagaaaagtacttgcacgtcgccgtaaaagaggaagaaaagtcttatctgcttaagaaaaatccactttacggtgggttttttttctaaaaatttatgaaaaaagaatttagagtacgaaaaaatgaagattttagccgtattattaagaaaaaacaaagtatggctaatcgttctttcattatatattacctaaaaaatgatttagatcatgctcgaattgggatatcagtaagcaaaaaacttggaaaagcagtaattcgtaacaaaattaaacgtcaagtcagaatgatgcttcaacaaacaattaatttcgatgataattatgattatatagttattattagaaataaatatttagatttagatttcaattctaatctaaatgagctaaaatatttatataaaaaaatattaaaaaggatggaaaaataaatggtgttagataacaagactaaaaaaatcttaaaagtattttgtttagttttcctagttgctatcttgacaggatgtgcacaaaatcttgatgcaaacggtaaattaattgcttctagggcaattacaagttcaactccttggtcatttgatgcagggtggtttgattttatctttgtaattcctttagctaaaggaatcttattcattaatgattatgtaggaaatgtagcttttggggtaattggggttacaattatcgttaatattatcactttacctattatgatcaaatcaaccgtctcaacgcaaaaaatgcaattattacaaccagagatggaaaagattcaacgtaagtataaagggcgtaaagatcaagcttcacaaatgcgtcaaaatgcagagattcaaaatttatataaaaagaataatgtaagtatgtttggatcatttgcaacattccttacattaccaatcatgtttgcaatgtggcaagcagtacaaagaattgatatattatattctacatatatttttggaattaatttaggggctaagccaatcagccatattatggatttggatattgcgtatattgttttattggttttagttgcaggaacacaattctttgcaatgcaaattactcaaataatggcaaaacgctcaccaaaatatcgtcctagtcaacaaatgaagtcgatgaatacaatgaacaatgtaatgacgatcttcattgtttacttagctgctacaatgcctgcagcaatgtcgttgtactggattacaacaaatgttattaatatcataagaacagtatatattcaattattccatattgagaaagcaaaaaaggaagttgaatcaacaactactaattttctaaataaaaagtaggtgaaaatatgaaaagatatacggcaagaacagttcaagatgctgtaaatacagcatgtcaagaactaggtgtaacaattgatgaattaaattatgaagtaattagtgagacaaaaactttatttactaaaaaagctgaaattgagtgttatacaattccaatgatccaagaatatattgaaagttatattcgtcgttttattggagatatgggatttgaagtggaaacagtttcttatctacaagatggtcgtatttactgtaatattaatactagtaataattctatcttaattggaaaagctggagttattctacgtgcaattaactttattgttaaaaatgccgtaagcaatacctttaagaaaagatttgaaattagcgttgatattaacggatataaagaagaccgttataaaaaagtagcatcaatggctaaacgttttggaaaacaagtattgcgcacgaaagctgaaatcaagcttgatccaatgcctgctgatgaacgtaaagtaatgcatcaagaactttctagatttgaacatattaagacagaaagtcatggtgaaggaaaaaatagacatatggttatttcatatgtagattagacacatgttatcatgtgttttttctttaaggagtgatatgaagatgaatatagaattagcaagggcaactgatgtaaatgagatcgaagcgttatatggagcagttgtagacgatttactagccaatgtaaattatcctggctggaaaaaaggaatttatccaactcgtgatgaagcaatttttggaatagaaaaaaaagaattatatgtaatgcggcaaaatgatcaaatagtggggagtattgttattaatcatgtccaagaagaaaattatcaattagcagcttggaagatagatgcacaagatcatgaagtttatgtaattcatactttagctgttcatccacaatttaaaggattaaaaatagctcaaaaattattagaatatgctgatgaattagctaaaaataatggggtaaaaacaattcgtttagatgttcgtaaaggcaatgtgccggcaatcaagctatatgagcgttgtggttatacatatgtgggagcaataaatcttgattttaggggttctgatcttggcttatttgaattgtatgaaaaaataatttaaataatgcttgccctatagttaggtttaagtagtatgcttaacttaggaggacgacttcatggataaaatagttattaatcaagaacttttattgctacttcaaaaaaataaaataatcgccacaacgtcaaactttaattaccgggatcaagcagtcatatcactaatcaaaacattgattactatgggatataatagtagtgatatcttagaattgattgatgaagaaatgactttgctggatattctagaatttcatcaagatttggtaattaataaacaatatgaatgctgctgtttaattaataaattaaagaaaatgattgaagaagttaaggaagagaccaatggaatatacaattaaagaagtaactaaaaagtacaatctaagtgcttcaacacttagatattatgaaaaagaaggattactacctaaaataaaaaagaatcaaagcaatcaaagagtttatgatgatgatgatctatcgtggttagacataattatgtgtatgcgtaaaacgggaatgacgatagcatatataaaaaattatattgagttgtgtcaagaaggtgacaatacgattaatcaacgatatgaaatttttttgaaacagaaagaaatattattattgcagcaacaagagttggaaaagaatattgagacagtgaattataaaattaatctatataaagaaaagttattaaaatagatagcaagaattattgctatctatttttctttcaattataatcaatataataagtaggtgataagatgaataaaaataaattattaatgttctttattattaatggactttttaatttagccgctaattatgctcatccaattactccaacagtaataaaaaatcttcaactgggagattatatgtttggtgttgcatttggggcaatgatgggattaaattttttattttcaccattttggggaaaattaaatgaacaaattaacagtaaaacaacgatgttgatctgtagtattggttacgcagttggtcaagttttgttttggcaagcaaattcacaaaatagtgtgatatttgcaagaatgttttcaggcgtttttacaggaggttcttatgtaagttttttaacctatgtcgttaatgttacaccacctgaaaaaaggggtcaaaatctaactgttttagcaacagttgcaagtgtttgtgctgcttttggttattttataggggggatgcttggggaaatctcaattgatttaacttttgcagttcaagcagctactttagctagctgtggtattttcttttatcttttttgtgaaaatgatgttgtttcaccagtcaaacaaaaagttgctctgctcataaaacaagcaaacccttttaattcatttaaacaagcaaaagtatttatagataaaaaatatttaattatgtttacgatctgctgccttgcatttcttggttttactgcttttgaacaaagttttaattattatatcaaagatatttataatttaacatcaggttataatggaattatcaaggctgcaattggaattatttctttagttgctaatggtacgatttgtttatggatcattaagaatactaatgtttctagatcgtcaatgctgattttattgttgagtagtgttacgatgttaggggttttagcaacaaataatataattatatttattgtgatgaatataattttctttgcattgaacgcaatcattataccagtgactcaagatttagtagctagccgttctaatgatactaatagtagtattgtaatgggattttacaacgcgataaaatcattgggtggaattataggtgccttgatggctggtttcttttatacatttaatcctcgcttaccatttatttttggttttgttgctttccttttagcaactgttttatcatactactattatcagcaaaataaattgcacaaaagttaaaacattgttataaatgttttgattttttttatttaacaagagtagaataaaattataggaaatagtaaagctaatgaatcatgatgaggctacgttttttagtataattagtattatggtaataaataagattaaaaataaataaatctggttagcttaatgcttgcacaaccagatttagcagaaattcattatttcaaagaagtgtgttagtatgtagaagtaaataactaaaactaactatattatttttgatgttttgttgaaactaaaatattttttattaatacttcattatctttagttttttcaaacatatttaataatgaatcagttgcttgttcgatcgtagtttgatctaaagattttcgaattatttgcattgcttcatattcatctttgcttaataataaatcttctcgacgagtaccggatttttgtacgtcaatcgcgggaaaaattctcttttcttgtaatttacggcttagtactagttccatatttccagtacctttaaattcttcataaaccatatcatccatccgacttcctgtttctattaaagcagtagctaagatagttagactaccaccttcacgtgtatttcttgcagctccaaataagcgtttaggaaaataaaatgatgcaggatctagaccacctgataaggtccttcctgaaggggtaacagttaaattatttgctctagttaatcgtgttaagctgtctaacaagatcattgtatcatatccttgttctgttaagcgtttagctcgttcaagggtagtttgtgcaactttgatatgactttctgatttttcatcaaaagtagagtagataacttcaacattatcagcatccaatgcttctttaatatcggttacttcttcaggtcgttcatcaataagtaagataaatatcttgatgtttggataattttttgatacagataaagcaatatcttttagtaatgtcgtttttccagcttttggtggtgcaacaataattcctcgttgaccttttccaattggagaaattaagtcaattagacgcattgataattgttcattatctttacctaaatatactctttcattaggataaatcggtgttaaaaattcaaaagcaattcttttttttgcttgatctggattttgtccgttaactaaatcaactcgcataagtgcattatatcgttcaccatttttagaattacgtgcatgaccaactatttcatcgccattttttaaattaaagcgtcttatctgtgattgggaaatgtaaatatcacgactttcttgagtataatttttaggtcttaaaaatccatagccatcaaccattatttcaagaattccagatgctaattcacccaattcgtcttcttctttggtatttaccttatttttatcattttttatactttccatagtatctccttcttattgttttattacaattaatattcattataatttagcttgctagtattatacaataaaatttattaatattcgtgattgtctttttcattatttgcaaatatcattctaaactaattaatatcgtggtatgattctatcaatgaaagattgggggattatcatggatattatggtagttattaaccaaatgattcaattatttttaattattggacttggttattttatgcaaaaaaagaaaatattaaatgatgaattaaatacgaaactaaattttattgttatttcaattactacaccagcacttattttttcatctgtttgtacaacatcgattagtgaaaagagtatggtcatttatactttagtaattgctacagcagtgtatgtggccttaccggtcatcagttttgttttagttaaattaatgcgaattccaatgcaccaaaaaggattatacatgtttatgacaattttttctaatactggatttatggggtatccaattatgaaagccttgtttggtaatgacgcagttttttatactgctttatttaatatcctttttaatttagaagtatttactttaggcgttattttaattaattatgggaatgatgtaaaaatgaaattaaatcctaaaaatttactttcacccggagtagttgcttcaattattgcaatatttatttattttttagaaattccaattcctgatgtaattgctaattcatgtggtatggttggggacatgacaacaccattagcaatgatgatcattggggcaaccttagctaatattaaagttaaagagttgttcacagaattaagattatactactttacgattgttaaacaagttattttaccaattgctgtttttccaatcattgcatattttatcaaagatccattgattcaaggaattactttggttaatttggcaatgccggtcgctaatagtgcagttctttttgctaaagaatatggtggagatgttgaattagcagcaaaaagtatctttattactactctggtcagtgtctttacaattccgttaatagtttcattattgcttgtttagtatacttttatattattaagtaaagaacctcgtgaatataacgaggttctttactattttgattacagaaaatatgtgattaggggatattaattttgggagaggtcaatatccccacttagattatatcaaaccaaaatagtgttatcaaataaaaaaagaccaaaatggtctaaaaattaaatttttacttatgaataaagttattttttgaaatatattataattatttgaaaaaaataacatttaatgtcacaaataacaagttagggctttcattcccaaacaaggccaaagtattgtttaaataaatgtgttatgagatagtaaatatgtacttgataggccgtcaaagtaaagcagaaaaagtagaaagagagataaacaaaaatgaaaaaatatagtgtttgtattgttggaggaggaagtacctttacattaggttttttaaaatcattctgtcgtatgaaagaacagttcccattaaaaaaattagttttatttgatattgatgcagagcgccaagaaccaattggtgaatttggaaaaattttatttaaagaacaatttcctgaattagatttctcatatacaactgatattaaagaagcatatgaaggaatggattttgtgtttatgcaaatgcgtgcagggggattaccaatgcgtgctaaagatgaacatattcctttaagcatgggattaattggacaagaaacatgtggagcaggaggaatggcttatggacttagatcatgtgttgatatgatcaaagcagttcatgatattcgtaattatgcacctgaagcttggatcttaaattattcaaatccagctgctattgtagctgaagcattaagaagagaatttcctgatgataagaaaattttaaatatttgtgatcaaccagaaaatgttgttcgttcatgcagtcgtttattaggttgtgattgggaaaatttagatcctgtatattttggtttaaatcattatggctggtttactaatatatacgatattaaaacaggggaagatttattaccaaaattgagagaattaattaagaaaaatggcttcttaccacaagatgcggaacaaagagatcaatcttggttggatacttatggtatggttgaaactttaatgaatgattttccagattttttaccaaacacatatgatcaatattatttatatccagattataaagcagcacatttagatcctaattttactagagctgacgaagtaatggcaggacgtgaaaaacgagtttttgatgaatgtcgtgaagttatagctgcgggtgttttaggtgataaattcgatgatattagtgatgcccatgcagaaatgatgatcaatgtagctgaagcaatcgcatataataaaaatactcgtcatattttaattgttgaaaacaatggagcaatcgctaatatgcaggatgatgctatggttgaagtcgtttgtgaattaggaattaatggaccaagaccaatgcgtgtaggtaatattccacaattttatttaggattgttagtaaaccaagtttcttgtgaaaaattaattgttgatgcttattttgaaaattcatatcaaaaagcattaatggcatttactttaaatcgtttaatcaatgatggtaaaaaagctcgtaaagtattagatgctttaattgaggctaataaaggaatgtggccagaattaaaataaaataataaaaggggattagtatgaaaaaaaataaagtaatggatttcttctcggctttaggaagaagtttaatgatgccaattgcggctttagcagcatgtggaattattctgggagttactgcagctttacttaaaacacaagtagtagaggcagtgccatttctacaacagccagttgtattttatatcttaaatacactaaaaacagtatcaaatgttgtttttaccttaataccagtattatttgctatttctatttcatttgggatggctaaagaagataaagaagttgcagcatttgctggatttattggctattatactttcttagtaagtgcaagttgtatgatcaattctggttttatgaattttgattcattacaaatttcaactattttaggcgtagaaactttagatatgggagcagtagctggtattttaacaggggtgaccgtagcggctttgcataataaatatcataaagtagtattcccagtagcaattgctttttatggtggtaaacgttttgttgcaattgtcgttatcttagcaatggcgttattaggacaagtagcaccatttatttgggcacctgtatcagctggaattaatggtttgggtacattgatttctgaatcaggtttattaggggtattctcatttggatttttagaaagattattaattccaacaggattacatcatgttttaaatggtatttttagaactactgcaatcggtggggtatatcaaggggtagaaggatgtttaaatattttcttgcaattctttgatagtgttgatattagtgtaatgcgtgaatatacacagtttttgggacaaggaaaaatgttgtttatgatctttggattacctgcagcagcctatgctatttataagacaagtccagatgaaaaaaagaataaagttaaagcattaatgattgcaggagttgcagcaagtattgtttctggaattactgaaccattagaatttgcatttatgtttattgcaccgccattattcttattccatgcggttatgggtggtatctcctttatgttaatgtcattattacaagtagcagttggaaatactggtggcggtattattgatatgtttatctggggtgtcttccaaccaggatctaattggtattggataattattattggtccaatctatgcaattatctattataatgtatttaaatggtattttaaccgcaaacatttatcaattgaagttgcggaagatgatggagacaaggatactaatgatactgcgagtattagtgataaacaacaagcgctagcaacaaaaataattgaaggcttaggaggatttgataatattattactgttaacaattgtatttctcgtttaagagttgatgtaaaagatatgtcattagtaaatgaagaagaacttaagaagacaggaagtatgggaattgttaaaccatcagaaactcatattcaagtaatttatggtcctaaagtagaacaagtagcttattcagttagagaagttttaaaatactaattaaaaaggcaacgaatttaatcagttgccttttctaaagctaatttttgagcagttagttcaataattatttgcataattgtaaagatacctagccttgaatttatgtctacgccatgataagttagattttcatcattactacttaaaacataatcacaagaatctactaatgaacctttagcgttagatgtaagtaaaataattttacagtcatgggtcttagcaatcgtaactacttcatcatatatctttccagcattgtttgctgatacaataaaaattgtagcaggagcctttaaattattaaagacactttttgatagatgaagatcattgattaaaatacaattaatatcaatagatgataaaatagtttgaaaataatcagcagccactaagcttaaactcctacctacgacatagatcggttgaggactacacaataaatcaacaacttcttcaataatttcataatttaagtttttaagattatcaagaaaacgggataagggcttttcaattatcatttgataatcaatttcttgatgcatactttgctttaattcatattttagttcattaaaaccagataagcctagcttattacaaaagcgcatgattgaagcattagacatatacgttgcttttgctaactgtgataatgtcattgatacaacttccttacaactattttcaagataatatagtaactctttttcattttcagacaaatctaaagatttagcattttcaagtaaagcaatcattattccttttcctttctaactaaataagttttaaatattacatcaataatatagaaaattgctaatcttgaagtatattcagtatcaatattttcacgatgattaacaaaaaaacgaaaattaatatttgctaaatcagcaatagcattcttagtatatggactaattgctataattgttgcatgatttgtcttaaattatatatgtctttttgactatctttttatattttcttaaatgtccgcaaagccttattttataggctctacgggcattttgcttttgtggtaaacctcacatatctaggtctatcttcttatattttcgctatcaatcgtggttaaaatcgtggtaaatacttctatgcaattagacgctgaacctctgattttgcggtatctatggacgcatgagcgtaccagttcattgtgatactgatgtttgaatgtcccatgatatactgtaaatctttcgggttcatgttcttgcttgccagtcttgtgcagaatgtatggcgtagcgtatgcggtgtgatatgtggcaagggtttgtccttgtggtgcttgttgtatttctttaccatacggacaaataaggcgttgtaatcaatcgcaactttgggcttgcccttatggttgacaaataagaaattgctccgtccgtctatcacaaatggttctgcctttgggcgttttttcataacccgttgaaatgcctgtattgtttctctgcttaatggcacttgccttattccgctctttgttttaggcgtttcaatataatagccctgttccttgctctttagtaactggtggtcgataatcacaacttcattcttgaaatcaatatcggctactgtcagtccgcacagttccgagatacgaagtcctgtttttaataatatcagcacatcatcataatgcttgtgatacacattgtccgtcttgataaatgagagtaggacttgttcctgttcctctgtcaatgcgactttctctttggtatcattttctaggacttcacttaacttgaaatcaaaagggttcttccttacgcaatcgtcttgtatggcgatatagaatgacgcttttaacgagcgtttatggttgttaatggtgttataggaaaaacctttttctttcatgcgtaacgcccattccttagcgtcagagggttttatcgtatcaatgctcctagcacctaacttatcctcttttaataaccgcatgagttgttccctttgtttcattgtgcttttcttcacatttgccctttgtgcgttctgtttggcatagagttggcaaagcgtcattttcttgcctgtgctgtcgataccgtcctcaatatcccgtcttatctgctgttccagttctcgaagtgagggtttttcccgttttccctttggtgttgggtctgtgggtgtcaatctccaagcgtacacatattttgtgtttccaaatgcgtccacatatttatataagtattttccgtctgttcgttggctctctccagtatgcaggatacgacctttgttatcccgtcttttttctttcatggtgtctgctcctttccttgttggaaagagccttgatatgacttgtgttcatcataacacatacaaggctcatttgcattagattgcgtccaatttatcaatgaccttttcaaactgtcggcgtttaatctgtatgcggttgccattcataatgagccagccagcgtccttgttttcctctgccaagcgtcttaacttgttttctccgatacggaaatactttgacgcttcttcaatggtaagggtgtatttttcccatacgggaatatcgttgttattcatcagataccccctttcccatgtttcgtgtcatactggatataggggataaggtcggtgcggtttatcctctgtaaatgggcggttaatttactggaaagggaattgctgtatcttgccttatcaagcatagttcctactttttccagtccacctaatgcgtcatgttcttccaagaagtaaaaacttttgacagcggaaatcacgccaccctctgtgagccattgctgtgtttcttcaagggaattttgctgttttggtacttgcagtttcaagacttccacagcccctaaaaagcgttcccaaaaccgacacgttttccatctgctcttattactttcatttctgtttggcacgacaaagcgtaggttgtttgccaatagcccgaaagccagttctcccaattctaacggtctatccttgaatgtcatggcaaaagcatgagccttatcatcacgcagttgcatttctgtccgtttccaactgccgacttcatcaagcgtcttattatgttttaaacagacttccttatccttatcataaaagcggtaggataatccagattttccagcaccgatataaacagtctttgcggtgtcgaaatcgtcaaacttgctttcatcaaagtggtagccctcactattggagataaattcctctttttcgcatttcttctttatctgctctatggtaaaaaatggcttttcgttcctatcatcaatggcaatatcaagtcttgtgaaatggaagttatccagtccgtatcttcgctcgcaacgtcggaacatatccccaaaggtataattcctactgtcgagaatacggaaaatatcatcacaacctctgccggtcataacaagataacagcctaacccttgtgggttgtcctctgtttttcttgcgtcccccgatacataaatatctccaatctgccagcgtgcttgataggtcttgaatttaacgcttgccgaatagacattgaaaatgtcagtcggtaaacctaaaatgtgcatgataacatcttctgcggttgcagtatcaaatacaatgctgatgtaatcaatcttaacggataaatttttgtgtgtagttatagtgcattactcctttcgtatgccccgtttttttgcggggtaaaaatagcgttttgtcctttatttatcacagtttctaggtactatgacatgtatgcgcagggcggtgttacatatacgccctttatgaacgcctaaaggcgttccctttcttcctgtgtctgatccgttcttaacgctcacgagccttgtaaggctcgtggctaaacggaacagccccagtcagaaaccttattttcggtctgatagtctatgcttattcatgctatcaaaatgaaaatacatcttttctatgcttactcaagcgtgtgattgaccctagcgtgcttaatcactctatctgatacgataataacgccattagaattacttgtcaagaagtttttgttgacttttagatatatattaagtatgatatgcttataaataccaagaaaagcaatgaaaggagtgtttatactaagtcatggagcattacgaaaagaaaatcagtttcttaggagagaacatacagaccataagaaagcatagaggaatgaaacaacaggaacttgcggacaaaatcggtatcaatatgcagagcctttccaagattgaacgtggcgtgaattatcctacctttgatacgctggaaaagataatggacgtgctgggagtaacacccaatgaattattgtcgggagaatggaagtatattgaccacaccgagccctatatcatggatattatcaaacgggaacaggacttcaatgtttccttagattacctgtctgaaaatgaatttttcgatgatgaaaaagaatgcacattttacaaggcatataaactcatacagtatatccataactacattaccaatgaggttacggagttggaagaacttatggaaatcaagcagttgatacagcgtcaaaaactggaacgcatgataaaagtacataaggaaatgcgagggttagaccgatacagagaacagcccaaagagtataaataccatgacccttatgatgattggatatttcgtcagcttgcggatatagacaacagaaacaacattcccgacacttctccacaagtagacttcaatgaagcagactatgaagattatctaaaggcgaaatggaacagaggtctttaatttcctcttgcatggaagatacagcaaacaaaaagcccagtaaagagtgcaaagcaccaccaatggtggcaaggctcttgacagggctttttcttttctgttgtggggtaatcaagaggaagaaagaaaaagtgtgcatttttgttccataaatgctaagggtatgctgatttttattgtggcggatatatggaactgttataatatggatatgaagaaagcgacaaatttgaaagtgttaataattttcaaacagcctcattgcatggaaataagaaacagactatccttaaagtaggaggtggcacaaatggcaaatgaagataaaaaagattttaatgctatgttgcatgatagtaaggatatgccaaaatttcaaattatcatagaccagaaaagtattgagaaatatggtggaaacaaaatgtattttgctcccccgattgactatgacaaagtaatgaaaaaagttccgtatggtaaagtgattacggttggaaaaatacgagaacactttgcaaaattgagtggtgcagattttacagagccgattacagcgggtatatttgtttctattgtagcgtgggcgagttatcagcgttccgaagatgaaacaccctattggagaacattaaaagcaaacggagaattaaatgctaaatatccaaatggtattgaagcacagaaagaaaaattagaagcagagggacataccattattcaaaaggggcgtaaaaatatacgatactatgtaaaggactatgaaaattctctttttgatttgaaataggcaaattctatttcacaatttcatatctctatacacaaagcagttagtcttaggattgactgcttttttcatacctaaatttcagattggagtgatgaaatggtgtttgttagagctgttcagtaagattatcggtgcataaaattttattgtggtgcagatatgaaaatgatataatgtggatatgaagaaagcgacaaacttgaatttgtcgagctggttagttcgagataattttgagtttgttaagatgtggtgcacttgatggaatcacaggtacgacatcatattatggaggatgaaatagatgataggtttgattgttgcgaggtcaaagaataatgttataggcaagaatggtaatataccatggaaaataaagggagaacaaaagcaatttagagagttaacaacgggtaatgtggttattatggggcgaaagtcttatgaagaaatcggtcatccgttgcctaatagaatgaatattgttgtttccaccacaacagagtatcaaggagataatttagtttcagttaaatcattagaagatgcattattattggctaaaggacgagatgtatacatatctggtggatatggactatttaaggaagctttgcaaatagtagataaaatgtatatcacagaagtagatttaaatattgaagatggagatacattctttccagaatttgatatcaatgattttgaagttttgataggggaaacacttggtgaggaagtgaaatatacgagaacattttatgtaaggaaaaatgaattgagtagattttggatttagggtgttttcataaatatattgctttttatgcatatataaattgttgtaagacaaattccagtttgaaaaggggaaatgaaaaagtggcaatttcaaatataaatacaattattagtaatgatattcaaaaagtttggaacattgttttagctgttgataaatataactcatggcgaagtgatttgagcaaaacagaaataataaatgacaaacaatttattgaatacacaaaaaatggatatgctactacatttaccgttaccgttgcagaaccatataaacgctgggaatttgatatggagaatagcaacatgaaaggtcattggattggtgtttttatagacaaagggaatgaaacacaaatagactttacagaaaatgtgatacctaaaaagtggtttatgaaaccttttgtaaaaacctatttgaaaaaacaacaaaagcaatttgttctggacttaaagaaagcattggaataataaaattcaagattggagggttggaaatggcttcaagtaaagattatttacaatttgttttagaacaattatcagaattacaagaaataacatatcgtgcaatgatgggagaatttattatttattatcgtggaaaaatcgttggcggtatatatgatgataggttacttgtaaaaccgacaaagtctgcaatttcttatatgccgacagttacttatgaaattccatacgaaaacgccaaagaaatgttattggtggaagaagttgataataaagattttctgacggggttatttgatgtgatgtatgatgaactaccaacgccaaaacctaaaaagaaaaaataaacagcttctagtttacaatttcatatccatatacacaaagcagttagttttaggattgactgctttttaaaaagacaccatttaggtgtaatgatgtcttttgggtgttattttataggtcatatcaaggctcattcaatcgtggtaaattcgtggtaaaatgagttttttctatacttcaaaatacttgaaagtatagtgtttatgcggataatcgaaaattagatataaaatttaaattaaataatttaacaatcttaaccgtagtgggataattaccactagtacttatagcgattaatatatcatcttcattggcattactagcaatatgtgctgctaaacgagatgatttatacttgtagacattttgacgaccaattgaaaataacaatttttcaagatagtcgacagggattcgggaaataccttcaccatatagatggattcttttattactatcaatcaaatcgatgatttcttttaaataacgctctttgattaataatgaagtgctctcaatatcatcatatagactagtaatagaatccattgaagaaattggtttctttaaattcgcaatttctttattttgctgttttaatgcaaacttaaattcagcaaaaccactaaaattaagtttcttacaaaaacgaagaatcgtagcagaagaaaaggcaacagctttagctaattcttgaatactcatgtcaataacctcatcaggatgatcataaacataatgaagaatatataattcactttgacttagatttttaattatttcatcatctagttgatttattaacataagtttcctcttttctttcatatagtaaaataattatacaataaaggagtaaaaaaatgggattatttaaaaaaaaagataaatatttaaaagccttcaccagtggtaagatcattccaattacagaagtaccagatgaagtatttgcacaaaaaatgatgggcgatggaattgcaatctaccctgataataatataatcgttgcaccatgtgatggtaaaatcacagctattatggaaaatacagaacatgcagttggaatcacattagcaaacggtgtagaattattaattcatgttggtctagatactgttaatctaacagaaaagattttttcagtaaaagtagctaaagaaagctatgtacatacaggtgaagaattaattacttttgataaagtaagactaaaagaattagggtatcaagatattacaatgttagtaattttagatacgggtaatactaagaaactagaaatactatcagaaacggaggcaattataaatcaaacaaatatcattaaatatatagattaaatattttattgaaaacaataaaaaataataataaatatagataatatccaagggtaatgatatactatgtactagcgaatcctgttggattttatcgaaaataaaatgaaacaactgaaatgaaaaaataatatttgaagagggagatcatgctaactgcattaatttatagcatagctctcttttttatgttatcaagatataaaattaggttgtgataaaaaaagttagaccaatctttagataaatttaattttgtagataaaatcagtgtatattgaagttgataagtaaagaaagatatacaagtttgcaggattttgttatagttagccagtgataggagtagtttaaatggagataaatattgcaatttgtgatgatgacaaaaattacataaacgaaataattcagtatttaaataattgtagttggaaaagaaataatagttttgtatatcatactttttattgtggagaggcattattagaaagtaagcaatattttgattttataattttagatattgaaatggataaagtttcaggtatagaggtaaaagaaatattttataatcgaaataatcaatcaagaattatttttctaaccaactatgaggaatatatgagtgattcatttgggaagaatgtctatggatatatcagtaaagatgttcttcataagatggatatcccgcttaataaaatatttaaagaacttttagaacatcgcttaattaaaataagcgaagatataattgatttatatgaagtatattatgtaaaagccgatggaccatatattaatattcatacaaatggcagttatgaagtttatcgcatgacacttaaagattttgctaataaaatacataattcaaattttattagaattcataaatcttatttaataaatatgaggtatattaacgaaataaataataagtttttaattttggataatgatgaaagattaccgatatcaaagagtaaccgtaaaacagtattaattacttatagaaaatatttattggagaatataatttatgactagctggataattttattaattaaacagtatattgatatagctaaatatttattaattggtgatgctatatttgatttaaataatgataagaaaaagagaactaaagaaaatatcatattatctagtataattttagtaatctatataatattttatagtaaaatagaggatatatggatagatttaaatgcactgatatgtttaatctatctaattattatttatagagataaattatttaaaacatttaaagtagttataattactattttaattacaacagtaatagaacaatttatagatttatttattaagtgtgatatatttgatatacataatattcaatttatcatatcaaatatattaagattaattgctattgttttaactactaaaccaataaaatttgctagaaatgtttacaataagaaatatagtttatctgaaatgccctggtatatttatatgaatataattttttgtttcagtgcaactttatttccacaatttatagttgtaatgtactataagtatataagttctagagtgtcagtcttgatagttatagttgcttatttaaatatagttatttcatttatatcaattattttgtttattaagaataagaaagaaaaagaacaatattatttagatagtataatgaaagataaaacattgaaattacaagaagattattataaaaaaattattgataattattctaatattcgtaagtttaaacatgatattaaaggacatttggcagttgtaaatgaattaataaattctaaaaattatgatgaagcaaatgtttatataggaaatatgtcggaagcaataactggtaaagatatttataacactaataatatctatatctctagtattttaaattcttttgatcaatcatttattgataataagattgagtttgatctgtcttattatattattagtgatttaaagatgaatagtatggacatttgctcattattttataatttaattttaaatgcagtagaagcaaatttaaaaatagaagataagcgttttattaaattgtatattgcaaatataaaaaataatgtactaattaagattgtaaatccgattgatgaaaattttaatttagatattattaaagaaaataaaactacaaaagaagataaagaaaatcatggctttggattaattaccattaataatattatttctaaatataatggaaatattgattatagtatacatgaccaatatttaattgcagatattacaatattgaatgtactttaaaaaagttttgttcattaaatacaaaaatcattattaaaatacagtaaacgctaaaaaacatattttatcgttattatttcctcaaaaggaggaagtagttgtggtagtatatggtttttacgattggttaaaagattggctatacgggaaaaaataattaaataatatttatttttcctaaagataacgtctcttgtggggagggaagtttatcaaatattgtcagggcactttgacagacacataatataataaaaactacgggttatatttccgtagttttttcttattgtgaaacaaaaaccacgtgctatgcgcgtggtaacaataaagctttagcgtctgggtaaaaaacctcctcgtgatataataattgtagcctggcagctgcaaataaaataacgaggaggttagtctatgaaagacacaaaaagtttatcacatacatcatatagatgtaaatctcatattgtaatagtaccaaaatttagaaggatggtaatatacaataaattaagacatgatataagattaattataaagaccttaattgaaagaaaaccgggagtagagctgatagaaggagagttatgtcctgatcatattcaccttctattagaaataccaccaaagtattctgtggcggagttcatgggatacctgaaaagcaagtcaacgcttatgatatttgatcgtcatgcaagtatgaaatataaatatggaaatcaaaaattttgggcaagaggctattttgtagatacagtaggaaagaacgagaagacagtgagagaatatattcaaaatcagttggcggaagataagttgagtgatcaaatgagtatggaagaatttattgacccgttcacaggagaaccagtggaaggggacaagaaaaagaaaaaaagtaaaagaccctttgagggtcagtgagcaaatgacgttgcggttgtcaaggcgttcagtggtcgaatgactagcgcaacaacatgcccttacagggcgggtgcataccacgtcttttaggcgtggttatgatttactatcaactattttcctttatattcaataaaatgacctttatagtggttttttgcttcatacagagctttatcagatttcttcattaattcttcgatagtattatttggaccactgctacatacaaagcctccagatacttttattgattgatatgaatgatcaggaagttcaattaattcttctttaaaataagaccataatttatttaattgatttattatagtatttttatcttgataattataaataaagagacaaaattcatcaccagatcgtcgtgcgattaaacaatttgatttagaaagcttatttaatgcgtaggtcaaacgtttcaaataatgatcaccaaaatcatgaccataagtatcatttatatgtttaaatgaatctaaatcaaccattacagctgcatataaatgattataattattgttattaatgactaaagttacttctcttttgaatgatgggtatagtaatagtccagttaaatgatcatgatctttttcgtactgaatttgttttttctttaaaatatcagaagaaacatcattaacagttccatagaaaccattttcatctttcacaagtcggatttttataaaagtatctttttcaagacaataaacatcactctcaccttcaattggattgctaataattatttgtagtttttttaatagttgttttggatcaagatacatttgatttgcttcttcatcacttaaatggagcagttctttcaatcttgcagtggcaaaaagttgttttgtatcattttgatattcaaatgctgctagtgggatatcgataatggagataatttttgatattcgatcagcggagttgacaacactattaaccatactgttgattccagagcttaaatctatcaattcttgattatcatcagcttttacgacagtatttaaatcgccattttttattctatttaaatcattgaggacactatgaattccttttaatacttttttgtttaatataacattgattgacacaacgataacgatttcgattgcaattaaataagcaccaattaataataaatcacttgaacgatttttatataaaatatcttttggaacagttgctccaattaaaatattatcatattctctagttacaaaaaaattttcagttttgtttccaatatctttaaaagtaccagattgacaatcttttaaattatcataagtatagtaacttgcttctttgtcgtctaaatcattagtgctggcaatcaattcgttggttgttttattgattgcaaaaagctgctcaccttcatttgtgggaaatctagaaaatatataggaatatgtattcctttgttgtgcttctaaaagtcgtgttggttcaagaccgacttgtactaatccttttttgtctttacgagccactccaacatatttcataattttaccttcagcagtattaggctgagcatcttgaataacatattcatcagggtcatcgctttctaaaattggtaaaaaaccacgcatttgttcaccattatgaaaatccaaaccaacatatttaggaactgatgagtaagcaattaaaccctcactatcacttacatgtaattcatctacatcaagtagtgtagctaaattttgaagttcagtgacactttcaatgatattaggatttttttcaataacataagcaaatgcttttgctctagttaaataatcttcatcaagactagatttcaaagatactaattcggtacgattattttcaattgtttgaattacttgattaatttttaaattaaatgtttctaaagttcgggcttgtaaagaatcagttgataagaaaaaatttattaaaagaacagaggctaatgaaatagacatgattatgataatgtatttcctaaatatcttctgcatttagccaccctcttccaatttgtaatgtatatatattattatagcattgttactatgtcttgataataaaaaaggatacagattattttgtatcccgttcgcaaccaaaaataatatttgcactttggcgtgctttagttaaaacatccatgacgattcgtgaatgttcaagcattttattacatgtagtaaagtcattattatcaatacattccgcaaaaactttaaattcgctatacattcgatgatagttaccagttggtagaatctcactatctcggccatttcttaaaatttgcacatcagttagaacactggtaggaccatcaatttttacacaaccttggtcaccttgaattgtagaaatgattggagcaccacaatctttagcaccaatacagattgctttaaatgttggatattccaagatagcaactcctgaagtatcaattcctttttcaatattagcaaaatattctactttattaggggcaccaaataaaccaacaacaaaatgaatattatatacatttaagtccattaaagccccaccagatttattgacatcaaatgctggtaatatttcaccacgtttaaaagcgttataacgtgaagaatattgggaataattagatgaaataatactgattttcccaatctcagatattttttcttttatttctttaaaagttggaagatactggtttgtaattgcttcaaataaaagacaattttgttgtttagctaaagcaattaattcatctaattcattgacatttgaagtaaatggtttttcacaaataacatgtttattatgcaataaggctttttttgtatattcgtaatggagatgatttggtaaagctacataaatagtatctatttcatcatcatttaacaattcatcataatcatagtatgctttttttatatgatgtttatttataagtgtttcaattttttcttgagattcttttctccctaatattgccgttagttctatttcatcaataatatcaatgaatgttaataaatcgtagacgatcattccgctaccgataattccaagtttcatgttgaattcctccctgcttaccaccattatagcattgattaggtatattaattaataataatttatgataaaatacaaaagataaaggaaggtgatattttgaacgaagatattattgttgcaattgcaacaagtcgcttagaagctgcaatttcaatgattagagtaagtggtccagattgtattgcctttgttcaaaaattctttacaggcaaaataatagaaaaacctagtcatacgatcaattatggatatatcattgacgatggaaaaagaattgatgaagtgttagttaatatttatcgaggtacaagaacatttacaggtgaagaaatggtggaaataaattgtcatggtggtgtttatattacttcacgagtattagaagtgtgtatcaaaaatggtgctagaatggctgagcgtggtgagtttagtaaaagagcatttcttaatggtcgaattgatttatcacaggctgaggcaattagtgatattattactgctaaaaatagttatgcaacagatttagcgttaaaaggaattagtggtagtattagcggttttattgaagatttgaaagaagatttaattcaaataatcactcagatcgaagttaatattgattatcctgaatatgatgatgttgaggaattgactgcttcttcgttattaccacgaagtgccaatctattgactaaaatgaataagattcttgatgattctaaaaatattaaattagttaaagagggaattaaaacagttattattggacgtcctaatgttggtaagagtagtttattgaatgctctgcttcgagaggataaagcaattgtaacaaatattgcaggaacaacccgggatattgttgaaggaagtattagcattgatggagtagttctcaatatgattgatactgcaggaatccgagaaactgatgatatcattgaaagtatgggggttgaaaagtctaaagaactgattcaccaagcggaccttgttttattggtaattgatggttcgcagtcattaagtagtgaagatatgcagttattagaactaacagaagatgctactagaattatcgtgcttaataaagccgatcaaggaacaaaagtagatttagatggtattgttattagtgctaaagataatcaaattagcactttgacagaagaaatcaaaaaaatgtttgagttaggtaagattattgataataatgatcatattctgacaaatgcacgtcaaacaatgttattacaacgtgctagtcaggctttaaagcaagctgttgaagctatggaaatgatgataccaacggatttgattgttactgatttatatgaatgttggaataatttaaaagaaatattaggagagaaagcgaaagaagatttattagatgaattatttaaacgcttttgtataggtaaataaaatggacaaaaatagaattttatcggctagatttctaggcttttcaaagtatttagggattgtggcagctatatcgtttgtagtatttctaataattaatgcttttaatacaggtaatgatatattattttggattagctatgttttattgatgttatcaataattggagctattcaatgtatctgtctatattttattggtaaatattatggttcaaaatctaagtaggtggttaaatggataaaacttatgaacgaataaatagtttatttgaacatggattaattgatagcggaataagtattttgatatcagttgttatagttttggttattaataaaataatcaataaaattataaaaaagaagataaatgatccgttgaaattagtttttccaatgcgtattaaaaaaatcgttttagtaacaattgttttagcaattattatgagtgaaattacggcgatgcagtcaatcattaaggctctgctggccagtgggggaatcttagcagttgtagttgggttagcatcacaagaagctgcaagtaatatgatcaatggttttatgatcatgacttataagccttataaaattggtgattttgtcaatgttagagaatataatgttattggaactgtaattgatatttcaatgcgccacagtgtcattgaaacattagaaagaacacaggtaattatacctaatacgataatgaataaagcaattattgaaaatgtatctaatgttaagactcaaaaagccaactatttatatcttgaggtttcttacgaaagtgatattcaaaaagcaattgaaattattcaagaagaaggaagtaaacattcattatgtttagatggcagaactaaagcacaaaagaaaaaacatgaaccaatggttaaagttcattgtgtcgaatttaatgatagtggaattcaattacgagcaacattattatctaaggatagtggtgctggttttcaattattatcagatttgcgtttgattattaagaaacgttttgatgaaaacgggattgatattccatatccgcatcgagttgtaattaatgaaactagagaaaaaaatgatgaacaaacaaaataggtggttagatttagctcaagagttacaatttttagctcaaggtggattagcatatacaaaagataaatttgatcaagaaagatttgagcgaattcgtcaaatatctgcagaaatggtcgctttacaaagtgatttaccgattgcaacagttacttcattattttgtaatgaaacagggtttcaaacaccaaaattagattctcgtggtgctgtttttaaaggtgataagattttgctggtgcaggaatctgatggacgctggtcaattcccggtggttgggtagatgctttagcaagtgttaaagaaaatacaattagggaattacaagaagaagccgggattgaggctcagatagttaaagtaattgcaattctagatcgtaatattcataatacgcctcgctatgcgtatggaattactaagattttcatagaatgttcttatcttggtggtgcatttaaaccaaatattgaaacacttgatagtggttattttagcctagatgaacttcctgaattagctgaggagaaagtaactttagaacagataaaaatgtgcttcaaagcacattttgatgataattggcaatgtttatgcgattaatagacaattactgggttgatttattcaacccttttattttattgattatttgataaaatatagatacgatcaaatagttaaaggaggtctacgaaatatgattatagaacacttattagatgataataaccttaccaatactgaaaaaagtattgctcaatttcttttaaacaaagatcaaaaaattaataatcttacaagcagtgagttgggaaaacagagttatacttcacaagcggcagtaacccgtctttataagaaattagggttcaataattttcgtgaatttttatctacattgatcttagaaagaaatgattatcttaaatataatgatctcccaactgagcatcctgaacagtattttacatctttagaagatactgaaaaagtaattgcctctttatatgaaaaagcgatgattcagacaaatcgattactagataaaaatgttgttaatcgtgtttgtaatcggatattgagtgcttcgtttatcgatatttatggaattggtctttcagatacgattgctaaagaaatgtgttttaaattacaatcattagggcttccttgttcatatcaaaatggtattaatattaaatatattgataatatgcagcagcatcaaagtaacgtctcgatccttatcactacgaccggcgataataacttaattaaagaaattgctaaaattttaaaaaataggaatgtatatacggtcgggatattaggtaaaaagggtaaggatctaattcagctgtgccacgattatctattatttgatactagtttatttgaagatattgatagcttatgtgctacttttagtgctgaatacgtaatcaatattttatatgcaacattgctctatcgtcttgaattatctaattatatgcactatttaaaatagctgtcagttgattatttttctaatgcgtttaaagcttgattaagaaccttttcaccatccatcataccgtaaatacgcatatcaataagctcaactggaacagtattgtttacttcttttttaatattattaagtaaatatctgatttgtggaccaacaagaattacatcagcaggttcttgggcaaattcatttggtaattctttttcacttgttgaccagattttgcaatcaatttcttttgttttagcaacttctcgcatccggtttactaataaacttgtagacattcctgcacaacatactaataaaatctttttcataattttctccttaatttttatttaatttaggtacaaataattgtttgacctaggaaaatatattcttgaatatcgtcaattttaattaaccgaggaatatattcttgtggtaatactgtttttaactcattttctaaatcttcaatattaggtaaaagactacaaaagataacgattgcctcaggcccaattacactaataatcgataaagaaatatatttaacaattttaataatatcttctggtgttttatatacattagcacctttctctaatagatttacggggaggtatttcatttcacctgccacgttatgcttgccattgattaatttattatcaatgatgataccagcaccagctttagtactcattggctgaaaaagtaacacaattgatgagtattgattttgagtagcatgatagccaattgctgcggtattaacatcgtttgtaataataaatttttgtgaatatttgcttgtaaacaattttttataattcatatcatcaaaaccattaatactggcagttgtagcaaatccattattaacaattcctggtgttgaaaaaccaataacttcaatacctggataatttaataaaacagtatcgataacatcatagatgtcttgaattgtaattcgttgtttaattgtttcattgtttacaataatatcactttgactttgataaagtcgatatgcaatatgaatccgattacgatttctaaaaagagaaatacatagaattttacgatgaaaggtgatggttttatttctaatcgaaagcaattgaacttgaccatttttgttacgttttttaattagttcttggtcaactagattaagaatttcttttacatcatatttagcaaatacttgtgcaggaatattaagtaaatatttatctttaaaaatctttttaacttttgcatacataaaagaaacttgaggtgctagtaggattacatcatattgttcaccttttttgaataattcgttgtagccagttgctgcaatttcataatcaagagcaaataactgaattgcttcatcaatcttataagcaaaataagttgttgtaagaccaccactgcagcataataagatttttatttttggtttcttgatcaatgtttttaaacattcaaccatttcataaaatagattaattgcatgatttatgttattcatttgaaagtgtaaaaagaaacaagattcttgatctattttactaataacatttaattcaataatattgaatttataaaaaataacattagctacaccatactttgtctccaagataattttattttgatcttttgatgaaagcataatttgacaattatcgatctgttgaaataaaatccactttttatatatcgatgtatatacatcttttaggaaatcttccattttcacctcccctttcagtaataactgataactaattaaataataatcaaaattattggctaataaaatgaagattagtgttttaggctagtttatttaaaagttacaacttgataaataaaaaagtgattaatctagtcgctttagttgaaatatttttaaaatttgattgactataaggtaatcttatagtttaagatggagaaagactggaggaatgaggatgaaaaattatatttttaaagatttcttaaaatatacatcgttaaatgttttaggaatgattggtttatcatgctatattctggcagatactttttttattgcaaatggtgttggtgaaattggattatcagctctaaatttagctttaccaatgtactgtttaataaatggcttaggactaatgattggaatcggtgggggaacacggtattctttgttaaaggtaaatagtaatagaacctcacaaaatataattttcagtaatgctctttattttatgcttattctagccattatttttgttgttttgggactaagtgcgtcgacatcattagcaaatcttttaggggctaatcaagatacaactatctatactgcaacttatttaaaaacaattatgttttttgcaccaatgtttatgttgaataatttattgattggctttgttcgtaatgatgataatccgagattagcaatgatgggaatgttaattggtagtttaactaatgttgttttggattatatatttattttcccttttggtttaggaatgtttggggctgctttagcaacaggggtagcaccggttatttcaatttcaattatgtctccatatgtaatcaagaaagctaattttaaatttcttaaaacaaaattatgtcttaaccattgtaaagatatttttttattaggattatcagctttaataggagaattagctactggaatagtaatgttgttatttaattttactttgttgaagtatagcgggaatataggtgttgcagcctacggaattattgctaatatcgcttttgttattgtatcgatgtttacaggggttgctcagggaattcaaccaattattagtaaaaatcttagttttaaagaatatcgaaatgtaaatttagcttatcattatggtctttggacagttattatatttgcagttattgtttatcttagcagttattttgctgctgctcagatcgtagctttgtttaattcaagtagcaatccggaattgctggatttggcagttagaggaattcatatttattttgggggctttatttttgcaggagtaaatatgattagtgccactttctttagtgcaagcgataaaccacgtcaagcttttataatttcatcattacgaggttttattttaattgcaccagtaatatttattttatcaactatttttaaagtagatggagtttggctaacttatgtggtaacagaattgattacttctataattactattattttaaaaagaaaatccgattttagtcttcactagaatcggattctttttcttctgattttttaattgttaatttgatttttgttacacgattaccttttacaccagtaattttaaatgtaagattttcataagttacactacgttcttgattatcatcaggaatttctcctaataaatgaagaacaaaaccactgattgtatcatgattaacattatctaattttaaatctaattcatcatcaagatcgtcaattagataatttccatcaacgataaaattatagtcatctattttttgtagtttaggttcatcgtcatgatcatactcatcttcgatatctcccatgatttcttcgattagatcttcaactgtgacgatccctgaaaacccaccatattcatctacaagaattgcaatatgttggcgatcttcttgtagttctttaaataaatcatcaatatttttagtctctaagacaaagtatggttttcgtaatagcttacgaatatcaacattgtcaaaaccaacttgtctagcttcaatagcaaaatccttcatatttaaaatcccaatgatattatcaattgaatcatcataaacaggaattcgagtatactgcattgacatcatttgatcaatgttctcacttaatgggtcattaatatcaatacaataaacatcagttcttggggtcatgacgtttaaagctaaactatcatcaaattcaaaaatattggtaatcatgtcagtttcaatttcattgaaaactcctgtctcttgtccactttcaaccattgaacgaatttcttcccgtgacaaagattcttcaacattttcatcatccattccaaataatcttaagacaaacttagttgaccaagataaaattttaataaatggtccagcaattttactgatgatcaaaataggcttagcacagaacattgaataccattccgctttttgtaaagcgattctttttggaactaattccccaaagattaaagtaataaaagaaattaaaatagtaatcaagacaactgcgattgtatcagcgtaaggaattgaccaaacttttaaaagattagctaaactaacagaaatacccgtagcagcactagctgagttaaagaaacctgctaaagtaatcgctacttggatcgttgataagaagttagttggctgatctaatagtttttctactaacttagctttcttatttccttcctcgcttaaacgacgaatcttgtttttgtttaccgaaacaattgccatttcgctagccgcaaaatatgcattgattaaggtaagaacaacgattaaaattaattgcaatgtgattgaagactcggggcctgcatccataaattaaaacactccttttttatgtaattaaattttatgagaattattctatcaaattcatgattgaatgtaaatatttatagccaatgaagattgttaagatttgattaaatgtcctgccaatattatactgagtatataaaataatgcaggtaatttaatataaagaggtaatttaatgaagaatttcgattataagggaagttatattaataaaacagatcatcatatttatattgctcctagtgaagaattaaaagatattattgctcattatacaattacttttcctagtgaagttcccgcctcatcaaaattatttcatattattcctgatgctagtggctgttttatttttcagggacgctctcgaagagatttttggggtccaatgagtgaaatcgtggttttagaaaatgatttgcaaaaagccccagctcgtttctttgtagaatttagaccaggaggattgtatcaaattagtggtttacatcaaaaaaaacttgtaaatcagcgtcagcaattgagatatttagatgtgcagcttgatgaagagttagcattactttatcaatcatgtaaagattatgaacagttgatcaaagcttttaataaatattttacgggaaaaagaaaagttaatttattaccagctcgtttgattagagctaaagaaattattgatcaggatcacggaaatgttagtttagaaaaggtagctagtgattgtcacctttcttcacgacaattattacgtgattttcataattacataggcttgagtggtaaggaatatgctaaggtagtaagatttaattatttattaaagcaaatagaagaagatgattttttatctttagcattgcaagggggctattttgatcaggctcattttaacaaagtgtttaagcagattacaaaaacaactcctaagaaatatttatcgaacttggcggatttttacaatgaaatatataagttctaagttataatttgcttaggatggtgatgaaaatgattgaatcgagatgtggaattatatgtagtgaatgtgagtttaaaagcaagattgggtgtgctggatgtattaatatcgaacatcctttttggggtgaaatttgtccggttaaatcgtgcgtagaaacaaaagaattaaatcattgtggtgaatgtgaagattttccatgcaaattggctaaatcgtatgcttatgacgaaaaacaaggggatcagggaaaacgtttagaacaatgcagatgttggggtaaaatcaaatgaaattagaagcaactgtcttagcagtcaaaaatctcgaagtttctaaacagttctatatgcaattgttcgatcaaaaaataattttagatcatggtttaaatattacttttgatggtggttttgctttacaaaaagattttgcctggctcgttgatgtccctagtgattgggtttgtgataaagcttgtaatatggaattatattttgaagttgatgattttgataaatttataaaaaagttggagacatatccaaatattaaatatgttcacccaatcaaaaaatataattggcaacagcgggtaatacgaatctttgatcccgataatcatatgattgaaattggtgaagcaatggatgtagtaattacaaatctattattggctaaaaaagatatagatgaagtaagtagaattacacaatatcctattgactatgtaaggaatattttcaataagttgtaggttgactacaactttttttatagatcaaggattctagtgaggtaaacagtccgtcgatagtaaaattataacttttatgttaggattaggacgtagaagggaagtaattttatggataataaagaaattgggatacgaattttatcagctcgtaaaaatcttgggtatactcaaaaacaattaggaaatttaatcaatgtaagtgataaagctgtatcaaaatgggaacgtggaatcgggtgtcccgatatctcattattattaccgttaagtgaggctttaaagatgagtattgatgaattgattggtggtactgtagttgataaaagtgagaaaaagacagttcaaaatctaatcaattatacaaagataaaagcaattgaaaacaaggagagaatcattaagatcagttatctttttatcacaatcgtaatgatgattggaatctttgtaccatgtttatgtaattattacctaaatcatagtttcacgtggtcaataataagtagtgcagcaattatttatgcttggataattttaacggttttagttcaagctaaagaaaatgttgttattaaagctattattgtagctagtataggggtaattccactgctttatgtagtttcagttcaggtgtattcattagactggtttttacatgaagctttggttattgctttgtttactaatttgtatgtatatatagtcatatggatatgggtaaaaacaacgctgaatatttggtataagattggtttatgtatctatttatcaaatattactaatattcctgccaactacatatctggtgtcaatttattttcgatgattatgaatttagctttaaatatgattgtcggaacaattattattatggttggctatacgagaaagcataattaagatgtttataaatcaaaaattgaaaaaaattatcaaaaacaataaaaaacttgattcaattaatttatttgaataaagaaggacccctgtaaaagaccaaagtatcaataattattaggaaaatattgatcatgattagtactctaataatgatacttaatagaacaattggttttagtcttgctattatgggaataattcaaatttttgtagcaatgatgctatgaaaacaaaggtagactatttctaactggaaatagttttttatttacaaaatcttattttaaaatttacaaaatagaaatagttagaaattgacggctatgataaatttacttagtacactacgtacaaatatgtaattaggggaaaagtatatgaaaaaagtaaataatcgaattattaaaggggtcctgtgtttagtaacattatcgacaatgttgattggtcaaaataacattttgactaaaggttatgcccaagatacttatagtgaggttgcaggtgaaagccatactggttcatttagtgtggatagtttaacacttcagccaggggcaacaacgacatcaatcaatctaaattggtatgcaccagcaggaacgacggtagcaaaaattcagtttggtgatcaaacttatgatgtaacagccaaaccattgacttcgccaaccgaaataaaaagtgataaatatactgatactggaaaattagtatgtaaaacgacaatcagtaatttaaaaccagatactaagtatacttattatatttcaaatgatgggggaacaacttggtcaaaggaatataattatacaactccatcaagcaatgaatttacttttggttttacaagcgatccacaaataaaggaaaacaaggaaattaattctgaaggttggaacccaagtgatgaaacaaatcaaaccggttgggcaactatgatggaaactttagaaaaacaaggtgttgacttagtagtgtcagcaggggatcaagttgaagatcaaaactggggaaaatcaagcgagtatgaggctttttttgcaccagaagaaatgacatcaattccatatgctccagctgttggaaatcatgatagacactatatgttcgcagatcattttaatttaccaaatcaaatggaatcattaactgaagttaaaacaacatttagaggacaaaatagtggaactagtcaaagtcacggaaattatattcaggcaactgaaaatgaaattaaaaataatgcagcttctaatggggtgacaccaaatagtgatggtcaatatgattttagtgaacgccgtgatatggaaactcaaggaaactattactatttatataataatgttttatttgtcactttaaatactagtgcttatcctgggggaaatgacgaagaaaatgcaaacaatcctaatgtttcaagtgcctctagagataattcagaggcagaagcaatcgtcaataattttgctcaaacattaaagagtgcaactagtgaataccaaaatcaatatcaatggattatagtcactcatcataaatctactcaaacagttgctaaacatgcagcagatagtgatattgaaaactatgttgatgcgggatttgaaaaacttatggatgagtataatgtggattttgtcttaggcggacatgatcatgtttattcacgtagctatgttttaaaagatgggcaaagaaatagtgaaagattagatacacttaataatcctcaaggaacaatttatattacggggaactgttgttcagatatgcaatattatacaccgtttgaaacattagataaaaataataatgctgattatccaatcttagctaatggtaaaagcggctctgcggcttacctagaaggagattcattaccagttggaaatcaagaatggaatcaagagtatagtcctagttatgcagtatttaatgttgaaaataatcgaatatcggtaaaggtttataatcttgctggtgatcaaactaatcctgatagtaaagaaatcgatgcgtttactgttactaaaaatagtgacggtggtgaaaaaacaactggttatgaaaacaattcagcattattagcgctagaacagtcagctcgttatgattcaggaacaactaacagtgatgggggagtaactgaaatagttgattataacacagtgacaggatgggcttatgctgttaatggacaatctggaaatttaacagcaattgccctaaaaaatatcgaaaataaggataaaatagacttattggacggtaatgacattgatattagttcgttagtacaaagtgctgattttacatatggtgatatgacatcagtagcagttagtcatgatggaacctcattggctgttgcgattcaaggtaaggagactaatgctaatggtagagtagctttatttgattgtaatcaagatggaacaataactttaaagcaattgttcgaagtaggtgttcaaccagatatggttgtctttactaatgatgatggacaaattttaacagctaacgaaggagaacctcgggacgggtatactggagcggttgatccaaaaggtagtataagcgttattaataccaaaacaaacaaagcaaaaactgttgacttcacagcttttgatagtcaacgagatgcattaatagaaaaaggaattgttttgaaaaaaggtgttttgccatcaacagatttagaaccagaatatattgcagttagtgattctaaagcatatattacattacaagaagctaatgcgattgctaaattagatttaaatagtcttgaaatagaagatatttattcagtaggatttgaagattatagtaaaattgcaattgatattgataaaaaagatgaaaaatataatgcacaaacatatgattctttaaaaggaattcggatgcctgatgctatttctgtttacacggttgatggaatcgattatttaataactgctaatgaaggagatagtcgtgactggaatggttattcaaatgaaatagaggtaaattttggtaaaggaaaaacttcaccaactggtaaaataacggctgataacagtggtttaactggtaaggtcacgttcttcgatactagtgattatgatggtcttaataatgaaaatgattatttatttgggggaagatcatcaacaatttttaaagctgatgagcagtcattacaagaaatttatacaacaggaaatgattttgaagtcaaaactgcagcatatttgccaaataattttaactgttctaatgatgatgctacaatagatgatcgttctggtaaaaaaggtcctgaagcagaagctgtgacaattggtcaaatcgaagataaaacatttgcttttattggattagagagaattggcggtataatggtttatgacattacgaatccagaaaaaacagaatttgttaattatattaattctcgtgattttagcacagatattggtggtgatgattcacctgaaggaattcattttattgcaggtaatgatagtattacagggaaaccacaattagttgttgcttatgaagtatctgggacagtgggagtttacgatctgactttgcaaaaaaatagtgatcaatcaggcgatgataaaactgataatccatcacaagaaccaacggttgaagaaacaaataatagttctaacacaaatacaaataacaaaaatcattctgtaaatacgggtgatgccagcaacattgcgattacaataatttctttaattagtacaattgttctaataacgattttaatgaaaaaggataaagttttagcagaggattaatctataataaaattaatattataaaaaagaattggttttgaaatccaattcttttttgtcgttgtaaaaagccactgagaaaataaaggagttggctacatatttaaataaatcatcaataatacattattctactaaaaaagcatatgttcattaataaatgttaattagaaagaatttaatttgttctttatttatgtctttttaatattttaaaacaactctttaatcctatattaattattagcatgctagacttttaatagctagaggaggataaaataatggtttaacttatttcaatatttaatattaaaaagaaaggaataaacgataaaatgaagaaaatattagcttttttattaatagctttattaattagtggctgtgagagtaatagtgggaataagagtattgatgaaggtgatgtatttgtagttggaatggaatgtaattatccaccgtttaactggcagacaaatacacaaagtgataccgcagttgaattagaaggcagtggttacgctgatggctatgatgtttatatcgcaaaggaaatagcagaaagtcttgataaaaaactggttataaaaaaattagcatggaatggtttgcaacctgcacttgaatcaggcgaaatagatgccattattgcaggaatgacagctgatgaagagcgtgaaaaaggaatagattttacaacaccatattatcaatctgaaatggttatgatcgtacggggtgatgatgctagtaaaaattataccgatattcaacaattttctggtaaaacgatcgtaggacagatgtcaacaagttatgatacagtaattgatcaaattaatggagttgatcatgctacacctaaacaatcttatcctgaaatgctggttgctttacaaagtggtgaagtcgatggaattactgcggaattacctgtggcccaaggaattttagaaacaaatcaagatctagcgattgttagatttgaacaaaataaagggtttaaagtagataccgcagtttcaataggtttaaaagagggtagtcgaaacagtactttatttaaaaaagtacaaaaatgcattgataatatttcatcagaaaaaagaaatgaaatgatgggtaaatatagtagtagtcagcctaaaggagaataatcatgtttgattttgataaatcatttacgatttttttagataactttgatttattttggtatggaacgaaaataacaattattttggcattagttggaacaatagcgggtttaataattggactgctatttggagcgattcgtgcaacaacgatagatattaaagataaaaagattattgtactaataaaaaaagcattaaaaataatttcagaaatttatatttggttttttagaggaactccaatgctggttcaagctatgtttttttatcatggattgcgacctttttttcaatggaatgcacttactgccggaattatgatcatttctattaatactggagcatacatggcagaaatagttcgttcaggaattcaatctgttgatcgtgggcaaagtgaaggagcgttatcattaggaatgacaagggttcaaactatgaagcatattatattaccgcaagcaattagaaattcatttcccgcaattgggaatcaattcattattaatattaaagatagttcaatgctaaatgtgattggggttgtagaattatttttccaatctagcagtattgctggatcaacaatgtcatattcagcgaccttcttaataacatgcctggtttatttgtgcttaacctcaattgcgacaattttattaaatataattgaaaaaagaataaataatccaatattaagataaagtgaggaaattatttatgagtgataatattattactattaaacatttaaaaaaacattatcaagccctgccggtacttctagatattaatttagaggttaatcgaggcgatgtaattagtatcattggagcaagtggtagtggtaaatcaacttttttaagatgtcttaatttattagagattcctgatcatggtgagatattgtattgtaataaaaatattttaaaagaagaacttaatcttaataaatatcgtagtgatgttggaatgatttttcaaagctttaatttatttaataatcttacagttttagaaaattgtgttatagggcaaatgaaagtactaaatcgcaatcgtgaagaagctgaagaaaaagctttattatatctacaaaaagttggtatggctgagtttgcgaaaaagagcagtacacaactttctgggggccaaaaacagcgggttgcaattgcaagagctttatgtatggaaccacaggtacttttatttgatgaaccaacaagtgcactagatcctcagatggtaggagatatcttaaaaatcattaaacatttagcgttaaaaggtatgactatgattattgtgactcatgaaatgcagtttgcgcgtgatgtttcgaataaagttatatttatgcataatggaattattgaagaagcaggaacaccagagcaaatatttgagcatcctcgaagtatgggaatgattcaatttttatcacggcaatattagagaacttaattagttctctttttaatagatattaatactatcttaatatctttaatatttaacttaacgctacattaattttattcatgctaaactcatcgtgtaaaaggaggacacttatgaatgtaatcgtaggagtgattggggtaatcggtgttgcaatattaggttaccttacagtgatattaattaagggggataaacagtaatggatatttttgtcaaatatctaggatatctaatcgttcttgttgttttagcagtaccgttaggtttttacattaataaagtcatgaacggtaaaaaagtttttttatcaagaattttagaaccatgtgaaaatttcatttatcgagttttacatgtaaaaaaagatgaagagatgtcttggaagaagtatttagtaagtgtattaatatttagtggatttggattagtatttgtctttttattacaaatgctgcaaggagttttgccgggtaatcctgcaaaggttgaaggaacaacatgggaccttgcgttaaatacagcaataagttttgttactaacactaactggcaagcttatagtggtgaaagtggattaagttatttaacacaatcgttaggtttaacggttcaaaactttgtttctgcaggaacaggactagcagttttatatgcattgattagaggctttacaagaattaaggctaaaggcttaggaaatttttgggttgatttaacaagatctgtaatctatgtcttaatgccgctatcagttgtcttatcaattattttagtgagtcaaggtgtaactcaaagtattgatgagtatcaaactgttaaattggccgaaccagttgttttagaagatggtactgaaattacagaacagacagtacctttaggacctgcggccagtcagattgcaatcaagcaattaggtactaatggtggtggtttctatggcgttaactcagcccatccattggaaaatccaactggattaagtaatttagtagaagttgtatcaatattattgattcctgcggctctttgtttttcatttggcaagggaattaaagatagtcgtcaaggtattgctatctttgtcgcaatgggaattatgctggtagcagcacttggaagtattgctgttagtgagcagatggcaactccacaattagaacaaaatggaattgtcgatattagtaaccatgaccaagctggcggaaatatggaaggtaaagaatcgcgttttggaattgttggatcatcaacttgggccgcttttacaacagcagcatcaaatggttcagtcaattcaatgcatgatagttatacaccattaggcggaatggtaacaatgttattaatgcagttaggtgaagtaatttttggtggtgttggctgtggtttatatggaatgttaggatttgttattttagctgtatttatggctggattaatggttggacgaaccccagaatatttaggtaagaagattgagccttatgagatgaaatgggccgtagttgtttgtttagcaacacctgtagctattcttgtaggtagtgggattgcttccctagttcctcaagttgcggatagtttaaataacagcggtgcacacggtttttcagaattgttatatgcttattcttcagcaggtggtaataatggttcagcttttgctggttttgcagcaaatacaccatttattaacgtaacacttggattggttatgttatttgttagatttattccaattttaggtattttggctattgctggcagcatggtacaaaagaaaaaagtggctgttactgcgggtacattatcaacttgttcaccactatttgtctttttattagtattcgtagtgttattagttggagcactaagtttctttccggctttagctctaggaccaattgcagaattttttggaatgttttaatcgggggataaatatatgaaaacagaaacaaagagtgctttaatggataaacaaatggtcattcgtgctattaaagattctttttataaattagcgcctaagacgcaagcaaagaatcccgtaatgttattagtatatatttcagctattttaacgacggctttgtttgttatttcgttatttgggattaaagatgcaaattctggatttactctaggaatagcagtaattttatggtttacagtgctgtttgctaattttgcagaagcgattgctgaaggacgcggaaaagcgcaggcagattcattgcgagcagctaagaaagatgttgaagcttataagattccaagcattgatcaaaaagatatagttgaaattgtatcatcagcaacgctaacaaaaggtgatatcgtacttgttaaagcaggacaacaaattcctggtgatggtgaagttattgatggtgtagcttcagttgatgaaagtgcaataactggagagtcagcaccggttatccgtgaaagcggtggtgatcgaagtgcagtaaccggtgggactacagttttatcagattggatcgttgttcaaatttcaagtgaacctggagaaagtttcttagataagatgatttccatggttgaaggtgccaaccgaaaaaaaacaccaaacgaaatggccttacaaattttccttgtagccctttcaattatctttgttttagtaactatggcactttacgcgtattcagcttttggagctaaacaagcagggatggataatccttcttcggtgacagtattagtagctttactagtatgtttagcaccaacaacaatcggagcactgttatcagcaattgggatagctggaatgtctcgattaaatcaagctaatgtactcgccatgagtggtcgggcaattgaagcagccggtgatgttgataccttattacttgataaaacaggaacaatcacactgggtaatcgtcaagctagtgcatttattcccgtagatggggtaacgagcgaagagttggctgatgctgctcaattggcttcattagctgacgaaactcctgaaggacgtagtattgttgttcttgcaaaagaacaatttaatcttcggggacgaagtattaatcaaatgcatatggaatttgtaccattcagtgcaaaaacgagaatgagtggtgttaattatcaaggtaatgaaattcgtaaaggtgcagctgatacaattaaaaaatatgtaacagaaaacggacatatatatagtgatgagtgtgaaaaggtagttactgagattgctaatcttggaggaacaccattagttgtaactaaaaataaaaaggttttaggagtaattcatcttaaagatattattaaacaaggggttaaagaaaagtttgctgatcttcgtaaaatgggaattaaaacggttatgataaccggtgataatcctttaacagcagctgcaattgcagctgaagctggagttgatgattttttagctgaagctacgccagaaggcaaattagaaatgattcgagaacttcaagctaaaggtcacctcgttgcaatgactggtgatggaactaatgatgctccagctttggctcaagcagatgttgcagtagcaatgaatacaggtactcaggcagctaaagaagctggaaatatggttgacttagattcttcaccaactaaattgattgatattgttcgtattgggaaacaattattaatgacaagaggaagtttaacaactttttcaattgctaacgacgtagctaaatactttgcaattattcctgtactattcattactttatatccgggattagatgctttgaatattatgggattacacagtaaggatagtgcgattttctcagcaatcatctataatgcattaattattattgcgttgattccattagctttaaaaggagtaaaatatcgtgaagtgtcagctggtaagttattatcaagaaatttattagtatatggattaggtggaattattgctccctttatttgtattaaaattattgatgtaattattgttgctttgcatattgtatcgtaggaggagaagtttaatgaaacatcttaaaacaagcgttctacccgctttaaaaatatttctgatctttacagttgtttgtggagttatttatactgctgctattactggttttgctcaaattgtttttcctgacaaagcaaatggaagcattattgaagtagatggaaaaaaatatggtagtgaattattaggtcaacaatttatcgatgatactcatatgtggggtagaatcatgataattgatggtgaaactttcacaaataaagatggtgaaaagacaatgtatggtttagcatctaacagttctcctgctagtgaagattatgaaaaggttattgctgaaagggttgcaatgattgaggctgcaaatccggagcagaaaggtaaacaaatacctgttgatctagtaactgtatctggttctggacttgatccacatatttctctagcagctgcggaatatcagattccacgtttagtaagaacaacaggaaagagtgaagctgaaattagaaagattattgataaatatactgatcatggatttcttggttattttggagaaacaacagtaaatgtccttaaagtcaatttggctcttgatggcattttgaaataaaaataagtgtctgtcattatgataggcacttattttaacaaagcaatcttaatacttttttaatatcctaggcgctataataaaaataacagtaaaggaggaagtgtaatggatgaacgaagaccagatcccgaagaattgttaaaacagattaaacaagaagagattgctaaacagcgcggtaaattaaaaatattttttggctacgcagcgggtgttggaaagacttatgccatgttggaagcagctcatgttgcttatcatgccggtgtcgatgtagtagcaggctatgttgagccgcatcagcgtccggaaacatcaaaattattggacggattagaggtcttacctcctttaaaagttactcataacggaatcatgctcaatgagtttgatttggatggtgcattaaaacgaaatcccgatttaatattggttgatgaactggctcatacaaatgatgagcagtgtcggcatttaaaacgatatcaggatattaatgaattactagatcatggcatcgacgtttatacaacgataaatgttcaacatattgagagtttaaacgatattattgcttcaattactgcagttgtggtcaaagagcgaatccccgattatatttttgataatgccgatcaggtagaactagttgatatagagcctgaagatttaattaagcgtttagaggctgggaaaatatatcagaaaaatcaggttcaacgagcattaggaaacttttttatgcttgataacttgattgctttaagagagattgcactccgtcgtacagctgatcgtgttaataaaaaatttgagcaaattaaacctaaaaacggcgaacatcattataccaatgaacatattctaatttgtttatcaccagctccttcaaatcaaaaagttattagaacagccgctcgaatggctaatgctttctttggtgaatttacagcagtttttgtagagacgcctaattttgaaaaaatgccgactaaagttaaacaggcattaagagccaatactaaattggcttctcaattaggggctaatatagtaaatttgtatggtgataatgttcctgaacaaattagtgaatatgcaaggtttgctggagtatcaaaaatcgtattaggaagaactaatactaaacgacgtttttcgcacaatagttttgcagatcaattaatcgctttaacaccaacgatcgatatttatatcatcccagataaaattagaaacaattataagcatacgtctttaaaaccgcgacaatttttttctttatcaattaaagataccatcctttcaattgtaattattcttattgttacattattaggaatttggtttagagatttaggatttggtgaagctaatattattatggtgcatattctaggtgttttagcaacttcattattaacggaaaatctaatttatactcttttgtcgtctttagtaagtgtgctatcttttaatttcttttttactattccgatgcactcatttacagcatatgataaaggttatccaataacttttgtaatcatgtttttaacagcttttatcacaggtactctaactaaacgagtaaaagaacaagctcgtctatcagcaataaaagcttttcgaacagaagttctattaaaatcgagtcaaaaattgcaacgggctaaaacaaaaaaagaaataattgatgagatttctaaacaattatttaaacttctagataagacaattattttttatcctgttgaaaatcatgaactaagtgaaccactcgtatttaaaagtaatgaacaggaagatgaaaaaatttatttgaataaagatgaggaagcggtagcttcttgggtttttaataataataaacatgctggtgcttcaacaacgacgttacccggagcaaaatgtctatacttagctgttcgttgtgaagatagtgttttgggagtaattggaatctatttagataagacagcgatcgatgattttgaaaacaatttattaatggctattttaaatgaaggagcgatggctttagaaaaagaagcttcaaatagtaaaaaacgtgaagttgaaattaaagcgaatcaagaagaactacgtgcaaatttactacgctctatttctcatgatttgcgtacaccattgactagcatttctggcaatgcgggagttttattagatagtgcagataaactatctaatgaacgtaaaatagaaatatatagtgatatttacgaagactcaatgtggttgattgatttagtagagaatttactttcaataacaaggattgaaaatgggaatattcaaataaataaggaagcacaattaattaatgaaattgttttagaagcgatgcatcatattagtaaagatagtgcagatcacattattcaattggacttatcagatgagttcatttttgtaaaaatagatgcccgactgattatgcaggttattattaatattgtaaataatgcaataaaatatacaccgttaggttcaactataaaaattacaactaagaagcttaatcaggtattatcactagaaatcagtgatgatggagaaggcgttcctgatgatcaaaaagaaaaactttttgaaatgttttatactcgtaataacttaaacggagatagtcgtcgtgggttaggattgggtctggctttatgtaaatcaatcgttgaagctcatgacggaaaaattaaagtaattgataattatccccgaggatcaatttttgtaattaatttgccattagaggaggtagatatacatggataaaccattaattttagtcgtagaagatgatcgtgctgtacgaagtttggtaacaacaacattagatacacatgattataaatatattacagcccaaaatggccaacaggcactgttggaaattgtttctcgtcgtcctaatattattttactagatcttggtttacccgatatggatggaattgagattattaaaaaagtgcggagctggtcaattgtgccaatcattgttattagtgctcggagcgaagataagagtaaaatagaagctttggatactggagctgatgattatttgacaaaaccttttagtatagatgagttattagcacggcttcgggcaacgatgcgaagattaaaatatcttgaacatcaagaaattgaagatgttgtttttactaatggggatttaaaagttaattttgattctggctgtgcctatttaaatgatcaagaattacacttaacccctatcgagtataagttgttgtgtttattagcaaaaaatattgataaagttttgactcataattatattttaaaagaagtatggggtgatgtaattcaaagtgatgtcccatctttacgagtttttatggcaactctacgaaagaaaatagaatcagatacaactaatcctaaatatattcaaactcatgtaggggttggttatcgaatgttgagagtagaaagagagaaagagtaaatcactttctcttgaatcattgagtagcaggctaggaggttaatatgaagaataaggataattatgttaacttaactaaaatcattgttatatggatattagcaacaatttcatcattaatattagattattttaaaataagggttgaaaacattcttttaatttatgttgttggagtactgataagtattattgaaacaagtaatattgcctggggaataatttcagcaataatttatattatgactttcaattatctttataccgatcctcgatatacttttttgattaatgatcctaattatttaatatctgtttttatttttattattgttgcaataattgtttctacattaacaaatcgactaaaaaaacagcgtgagattgctttgtatcaagaagaagtgacatctaaaataaatcaaattagtagtggctttttaaatctatcgggttatgaggaaataaggacttattgccaggacagtttatataatttaacgaaaataaaaaatgaagtatttctatatcaaaataaagagtttcaagatttaatggcatggtggtgttattgtcatggtgaaccatgtggaaaggatcaaaagaaattcacatatttaaaggaagtatatttaccaatcaaaaaggataattatacgtatggtacgatcaaatttgattgtaatcaaagaactattactgatgaagatcttatttatataaaaacaataattgcggagttgattttagtattacaaagagatcttttaagccatgaaaaagaagaagctagattacaagtggagcgagaaaaattaaaaagtactttattaagaagtatttctcatgatcttagaacaccattaactagtattgctggtggggctaattttttagtaaataatttggatacagttgagtctgatactagtctaaatattattcaagatattagtaaagaagcaatgcgtttaaatgggatggttgaaaacctattaaacatgacaaggattcaagaaggaaattttaaaataaataaaaaactagaagtagttgacgatattatatctacagcagtttcagcaattactaatcgtaaagaaaatcatgaattagttgttaaagaaaccaaagatattattttgtttccctgtgatgctcaattaattgttcaagtactcgttaatttattagataatgcttttaaacatactcctgacgctagtaaagtgatgttaaaagcatttgttcgaaataataatattatttttcaagtaattgataatggtaaaggaattgaaataaagcagctcaatcatatctttgacgatttctttacaaccagtctagataatggtgatcataaacgtggaattgggctaggtctagcaatatgcaaagcaattgttgaagcgcataagggtgaaatcaaggcctttaataacgatttaggtggggcaacatttgaattaagcctaccgttggaggaagagaacaatgaataatacaacaattctaattgttgaagatgacaaaacaattcaaaactttctaaaagtaactttaaaaactcaaaattataactatattattgccgaaactggactaagcggtttatcacttttctatgccaatcgaccagatttagttttacttgatttaggtttgccggatattgaaggaattgaggtgcttaaacaaatacgtcaaaattcaagtataccaattatcgtcgtttcagctcgttcatcagaaactgaaaaagttatggcacttgattatggtagtgatgactacgtgactaaaccttttaatgccgcagaactattagcacgaattagagcagcactacggcattgcttaaaagaaaaagttagcgaaccaatatttgaattagattatttgaaagttgattttgaacgacgacacgtatgggtcaaagatcaagaaattcatttaacaccaattgaatataagatgttagtcttattgattactaatcgtggaaaagtattaacccaccattttattcaagaaaatgtctggggatatgaaactacagatgattatcaatcattacgagtatttatggctaatattcgtcgtaaaattgaaattgatagttcctcaccacatttcattattactgaagttggggtaggatatcggtttgttgaataatattaatgtaatctttatatttagggctaagattataaatagaaaatttattcctttccatgctacgatatcagtgtagaaagggagtgattatatatgttgaaaacagcatatatttatcctcataataccccaagtattgtaaatagaggaaagattataaactatacaaaatattttattactgatgtattttgtgttttcaaattggctttattaatgctattgactggtgcattaatggttggcggattattccttgttgtaggaatgccatactttgttgtatcattatttatttaatcaatttagataaaaagacatagggtaaaaactctatgttttttaataagtatttggtaactatcagtgttattaacaaatttagatttatattttaatgtttttaggaatagttttaatttgtttaaaataactaaattatttttattaaatggaatcgtactagtaataggcaatccaaaagataatgtttgtcttgcaatggtgttatctgctaaactatgatcaattatgaaattaaatagctgttcaacaataataattatcatagtttttttcagtaattatgatagaagctagatataaaagaagattaatatttttatcaattaatttattaatatattgatctaagtaaaaattttttattttgttagacaagccttgttttgaagaaatgaagactactttatttgtattatctttgattattaaaatgatgattgccattaaaaatattcccgcaagcaaatggttttcttgatacaaatactggttctaattatcgcttggatttattaacagcattagctaattttttactgggttctcactttggtgatttattgaaaaattaatataattttaataactaaatagactaataattattgtaaaagcaagagtgataagtttagctctatagctaatatcgattcttttcatttcatgatccgatctttattgataagctccgattagtaaaagaatagtgatattggtgtcttttaataatctcaatacagtcattaaaggtttttagatcatcatcaagataattaaaattattatttgaaaaagttattttatgatgatttaattcaataattagttcgtcgttttgattactatggcgcagagaaaaattatataaccttgtaaccaaatcaattatctgttcacgattacctttgataatcatcatttgtggtttataggataactttatctttttaaaattcaacacattagcactgttgtgtactaattgggtgattagttgtgaaatatctatttcttctatattttctggaatcgaatcaaaactcgaagctttagaatcaggagaaactggaatttgttttttttcagcaaagattattcctactccaagatagatcatccctaaaaggatgagcgctaataaatagttataatagtgtgttgctaaataatcaaaaaaggtatactcttcaaataaaccatcaaattgataccagactaaatagcctttttcattaaaatcattaattccatatagctcattaaagtcagtatgctggctatattttcctgataattcttgaatacaaatacttgatgtaattgtacttgttgtttctagaatctgcttttgattagaatcaatattttgataataaccgttttgatcaagattttgataattttttttaaaacatttttctaaattttcataagattgcagggtataattgtaagcatagtcgctatcatattcataaatagtaattaaagggcagtctagactgacaagctggcaagtaattgttgaagaatttgcttgccctaaaataacttgttcatcaaaggctaaatatgatagttttgagacttcaataaaatcattgttgttttgatcataatttaatgtaacattaattgtttcaatattattttctgatacttgagaaagtagatattggcttaaaatttttaattgatcataatttagctgctttaatgagataactgattctttattattactatttatagtcattgaccaagtttcactggctggtaaatagggattaagctcttcatcataaacaatataggtatttgtaagaatacgctcaaattgtgcattaacggcatcttcaacatgatatgaagaaatttttaaatcatcattaatactatcagcaacaattttaacaggtgaatcgtctttatagatctgtttagccttttgataatcttggtatgtaaaaaagcttattatgatagcgatactaaaagttataagaatcattattttagcaagtttattaaagtggattcgtttcatcggttgctcctttaattatttgtttaaataataaattattgtggtcaaaagtatactcataattatgaattttaataatttctaaacagtcatttaatgcagttaagttttcagtagtataagtaaaattatcattagtgaaggatagtccgttttcgataaaaataatcgataaattatcattactagcactatatctaatcgcaaaattatataaagtagttataagttttgttatttggttacgattccctttaataatagttgtctgaggctgatatgataaaatcaattttttaaattgtaataagtttgagctattatcaataagttcagtaataatcggttcaatgtcaacatcttcaacattctttggtgtaactgcgggaactggattaagaacaattgtttcatattgtggtaaagtgatgatatttcgttttaagattaaaataaagagaatactagttatgccaataagaagatatatatagtaatagtcagtaaaataattaaaaatagtatatttttgataataatcgtctacttgattccagactagatagccaagacgatcatcaggataatcaaattctttagctgaaaatgagtcatgatgactatattcgcgtgacagtttttggatacagtaactaaaattatatgcattttcttctgcttcgttatttattttaaacggatcatcatcaggggtcgatagtttatagtaaccgtcatcttgagtttttgtataattttgcttaaagaaattttctaaatagttatatattttaatgtttgaattataataataaccattccagtcttcatctgatggaatctgaatatctagaaatggtgtatatagatttgtgagttcgcaagtaatggtagcagtagagtcattagagatatatacttcgtcattgattgcaaagtaaactaaattacttacgataatatggttatcggtaattgcagaataattaaaagttacattgattgttttagtcttatcttcatccatcaaggcaataagtttttcacatattgattttaatttttgatagctgatttcactgagtgaaacctcagcaatattatcaccatttttagcagcaaagtgccatctttcatgaggggctaagaatggttgaaaatcttcatcaaaggctagataaactgatgtgacgtttcgatcaatattagctataacaacatctgtaaactgtgaatagttatattttaaatcatcattaatatcatcagcaacatatttagttggccagtcatcttttattgttgctttatgtgcataatagccaaagtaagtgaagattgtagtaatcatcatcatggtgataatatagatacttgttattttggtaaatttgtttagtcgtaacatgattgatttcccctttcatcatatagtaatcaaatttatcaagtaaattaataatttcccctttttttaattttatcattattttgctttaaagacttgtaagataataaaaaagcagactttagtctgcttgattatggcatttagacttgaaaataatgccaccaataacgaacatacatgcaatcaccacaactccgtattttgaattatctgtaatttgagtagtaatccccattaataaagttcccataaatgaggctcccttaccaaatatatcaaaaattccaaaatattcactcgcctgactttctggaatgatttgagcataatatgatcgcgataatgcttgaattgcgccttgaaaaacagcaacaaaaacagctaatacccagaatttccaagctgtatcaagccataaagcaaagacagcgatgaaaaagtatccaataatgcaagaaaggatcaatgatttaacagggaattttttagcaagttttccaaaaatcaaagaaaatggaaaagctactacttgagtaagtaataaagctagtagtaaactattatcatcaattccaacatcttttccatatgaagttgccatctcaataatagtataaacaccatcaatatagaaaaagaatgcgataaggaagaagagtacctttttattatttttaatactagttagaacacgttttaaattattaataattggttctttagcggttgtataattaatttgctgatagtttttcaataatgggatagtaataaaaaaccaccacaaagcattcatgataaaggcaattgctgttgccataacagttgaaaggccaattgtatcacaacctaaaatcaatagtagactgattgtaaaaggaatacaactaccgatatagccccaagcatatccgtgtgaagaaacttgatcaacccgctcatatgtcgtaatatcaaccagcatagaatcgtaaaagatcaaactggtcgcaaaccccgttttagcaacgataaaaatagctaaaaatacaatccagccaactggaatagaaagggcagctaagcttaatactcccatcatcataaagaatgtaaagattggtttgcgcacacctttacgatcaccaatacttcccagcataggtcctgctaatgcaacaatcaatgttgaaattgaaatagcatagctgtagtaagcagtagaatcacttaaagatattccggcttcagtagctaagtttttaaaatagattggaataatagttgatactaataatacaaatgctgaatttccgacatcatataaaacccaatacttttctaattttgttagtttattcatagttgtaattgaatcgttttgatattgcagtattgttctggtaactgtaataatattcgattatctcctttgtggcaatatttatcgactggttaaaaagattaactaatatatcaatgttttcttcaattcttttttctggttttgcagtcatgaccattccacagtataacttagcattaacaattttcattcctgttagaatcaaagatctttttaaaacactccggcaagcaaaaagatgattaaagcgtttaaatgattttaaagaagctaagatcgtggctggagctaaattaaaaaacggagcaataattttagcattttcaagattgatctggtaatgttttggggttgaatagttaaatgattcatggtttagtatcataaatcgctgatctaaatctcgctcgatttcaaagtgaccaatttcacgattaatcattgttttatcgatgtaaccatgacattcactatctaaaataaagtgattaataaaacccaaaatataggctaatgatttttcgtttggttgttcttttagaagtttcattgcattttcaaagaaagctcgtgcaatatcttggtgtagctgattacctaaagtattgacaggattttttttaagcggttgatagaaaaataaaatatcagggccttgaagaccaatattgtagagatttaaattatcattaataatttttttaattgtagtattttcaagcttatttaaaacttgattcccaaattgctgatgtgtataacttgacggcatagttaacctcccattcttggatattatataaagatattatttgttgaacgagcatgattagtttaagattaggtaaatatttatctaagaaatcttttgattaaattatactgtaattcgaagaataattacaatttattaataataaaactgttcatttataatgaacagttcgatagattatatttaaaaagcaataattttatttgaaattatgttcaaatcgacatgatagagaacgatcatacttaattacatcaataaaattgtagattgcttcatatgattcactaatactttgattaaataaactttctaacttttctaagtatgggtcgactaatttatttggtctgtaatttacaacaaacccctggaatcgtttatatgtaaatgtgatttttaaaactaggtaaatcaagccccgtttataaaactgtggtgctaataataaacgatcatagaacttcatccctttaagactcttatagagttctttttttgttgctttaaaatatggctcaatgttgttgagcgtatgatcattaaccttaatgtgatcagttaatttagttcttagaggatctaaacgatctttgaccataaaataacgatcgagctcagtttctatttcaaaatgagttacaccagtttctttgataatcgtattaatatacgggtggcagttactatcaagaatgtagtgacagatgaaaccacaaagataagcaaattgtggggcacttttggtttcttttaagatttctaaagcttggtaaaaaaagatgtcagctctttctttatgcatagcactacctaaacgattgattttactatggatatacgggcggttataaaaaagaatatcaggaccatgtaatccaatatcaaatagatcttgattagtttccaagacatgtttaaggggctgatttaattcatcaagcactaattgtccaagacgataatgactataagctgccggcattattttagattatcgtattcattggctttaaaaccaactaatacactatccttagtttcaacaattggtctttttactaacatcccatcagtagctaacaattctaattgctcatcttcagtcattgtgggaagtttatcttttaattggagttctttgtattttaagccagaagtattaaagaagcgtttgagcggtaagccgcttttttgatacaaagcagttaattcttctttgcttaaacgttcttcaacgatatgtcgatcatggtgatcaatcccaagttcatcaagatatttcttggccttcttacaagtactgcattttggatattcaataaaatttatcatattctcacctcgtctatagtttaactcattttatcctattttaacaatgttatgcatagaaaaataagttataatttaacccggatatttttcctaacagttaggaaaaaagattgtaacttaggaaaatgaatgcgtgatatattataaaaggagctgataaagaaatgctaaacaaacgccaaacaaatattattgatcttttaaatgattatggaaaatggattactggtaaagaaatcgcaaaagttctaaatgtatctgaccgaacaattcgttcagatatagagaatattaataattattatgattgtatactgattcaggctaataaacgtctaggatatcgtttagatgagacattattgcataagcaggatattgaaactaaagatataatcccacaaacttcccaagaacgttgtatatatattattcaagaacttttgtttaaaagtcatgaaattaatttgattgccttgcaggatcaggtttttgtaagtggttattcaattgataatgatataaaaaagatccgtaaaatgattaatgattaccctagtttaaaactagttagatctaaaaattatattagtttagaaggaaatgaaacagataagcgaaagttatacaaacagttattgacggcagagacacaagggaattttatgaatttaaattcaattgcaggattatggaatagttttgatctattagaagtgaaagatgtactagaagaaatttgtgaaaaatatgattatcagattcatgagatgacttttccaatgatcatgattcatgccggagtggcgattgagcggatcattaatcataactatattaagaatcaaacaattagtgaaaaattagaaagcagtcgagaatatcagatttcatatgacttctttacacaggttagtacgatgatcaatattgaacttgttactgatgaagtaattttatttgctttattattaatgggaaaaagggcaaatgattatcgtaaggatattatcaaagaaaagctggcagtcgatgttgaacatttagttgaagcagtaattgttgaagttaaggaatattttgatattgatttttcaaaagataaggatttaaaagtgggtttagcaatgcacttacaatcattgttagagcgtcaaaaaaataatgttcaagtaactaatgtctatcttcaagaaattaaacgtaagtatcctttagtatttgaaatggcagtgcgtgcaggcgaggtattagctgaaacttgtgaggttaatattaatgaaaatgaattagcgtttttagctttgcatttaggagcagcgtacgatcgggtcaattctttaaaacgctatcgtgcgattatgatcattcctaataatcagatgctatcaaagatgtgtcgggacaagttaaaaattcgttttgaagaacgaatgatgattgttcaaagctatggcttttttgaagaatcgatggttaaggaagaagaaccggatttgattattacaacagtaccactaaaacataatttaaatatcccaacagtccaagtaactttatttattaattatgaagatgaaagtaaagtatttcagacactaaatattttagataagcatcgctatcatgatgattttgtttcattgatcaaagaattgatgcgtgaagatttatttcatgtaaaaaatactatgaataatcctaaggaaatcattgattatttatgtgatgaactgattgaaaaagggttagcaacacaaagctataaagaagatgtttttaggcgtgaagcagtttctgcaacttcttttgtaaatggatttgcggtaccacattcaattgaagtatcagcaaatgaatcatgtatatcaactttaattttagataaaccggtgatttggggtggttttgaagtgaaattgattattcttcttgcaatcagagaaacagataatcatttattgaaaatcttttttgactggttgagtagtattgtcagtgattcaaataaattcacccaactgttagaagttcgggaacatcaagaatttatggaacaagtaataatgtaaggagagaaagatggcaactaaagtagtaaaagcgaaaaaagaaagaaaaataaggtatgaagatgctccattagtaaaacgatttataagctatttaattgactggtatgtcggggctttatgtactgcgattccgattgcgattatttcacaaaagttaacgaatacaatgttaaatcaaaacattgttgaatttaaacagccatatgggatcattgcaggaattttagctgttttatttgcaattttttactttgtaattgttccagcttatatttatccggggcaaacgctcggcaagaaaatttgtaaaatcaaaattgttaaagtgaataatgagcaagtaacaataaaaaatatgctattaagacaattattgggagttattgtaattgagggtgttttatatactgcaagtgcaatctggcatgaactggttacgattattacccaaacaaattttgttacacctttgatgtatgcaggatttataattagtggaatcagtattttactttatttatttaaaggagaacatcgtactttgcatgattatttaggaaatactaaagtagtgctatgtaaataatttcctaagtctaggaaagatgactagcaacaataaaaaaattaattacttataatgttgattgtaagggtattggaggataaaaaatggatggtttagagttagtgagttttaaaattatatcagctgtaggaatggctaaatcaagttttattgaagcaatgaaggttgctgctaatggtgaatttgatgcagctagagcaaaaatcaaggaaggtgaagaatcttttaacggtggacacttagcccatagtgaattgattcaacaagaagctagtggaaatcatgttgtaccaagtattctgttaatgcatgccgaagatcaattaatgtcagctgaaacaattaaggtcatggctttagaaattattcgtttaaatgaacgggtcaaagcattagaaaaatattaacaataacaaagggaggacaaagaaatgaaaaaagtttatctattttgtagtgcgggaatgtcaacaagtatgttggcaagtaatatgcaggatgttgctaatcaacataatttacctattaaagttgctgcctttccccacaataaattagaggagattatctcagaggatcgtccggactgtattttattaggaccacaagtgaaatacatgtatgaggaaacggtagaacaatttggtagccaaggaattcctatagctgtaatcgatcaaggtgattatggcatgatgaatggtgaaaaagttcttaaatcagcgattagactgataaaagcaaataaataaaaaggagggtaaaagaatgattaaacaacttgaaaaaatattaatgcctttagctgaagctattggccgtaataaatatttagtatcaattcgtgatgggttcttagtatcaacaccattattgattgccggttcaattttcttactgattgcaaattttccaattcctgcatggacagaatggttaagttcagtagtcattaattcaaatacaggggagacattagctgcttttattgaaaagccatcaggagcaacctttactattatggcagtctttgctgtagtagggattgcttattcatttgctcgtcagatgaagactgataaaatatttggagcagcggtagctatcatgggatggttcttgatcatgccttatacggtagaaggaactgtagaaatggcaggtaaagaaataccagtatctttaacaggtatcccaactggatgggttggggcaaaaggtatttttgttggaattatctgtgcatttgtagctgtgcatatttattcatgggttgagaaaaaaggctgggtaattaaaatgccggcaggagtaccgcctactgtcgtacaatcgtttgcggctttaattccagcaactgttgtaatgactttcttctttgcaattaacttattatttggttttttaggaacaaatgtgtttcaaattatatttgaattcttacaaacaccattacttaatttaggagatactttaggagcgatgattattgcttatatcttcttgcatttattctggttcttcggagtaaatgggggttcagtagttggtgctgtatttaatccaatcttacaaacattgtcagtagaaaatattgaattctttaaaacgggtgttggtgaaggacatattatttgtcaacaattccaagatttatttgcaactttcgggggttgtggttcaacattatcattgattattgcaatgttattattctgtaaatctaaacgaattacagaattaggaaaattatcattagtaccagggatttttggaatcaatgaaccaatcgtatttgggttaccaatcgtgttaaatccaacaatgattattccgtttattttggtgccaacaatcaatattattatttcttatcttgcgatgtctgcggggttagtaccgatttgctcagggattaatattccatggacaaccccagtaattatttctggatttttagcaactaactgggttggtgctattttgcaagcagtcttactagtattaggaatctttatttacatgccgtttattaaaattatggataagcaatatattaacgacgaagctaatgcagttcatgaagcagaagaagacgatttttcattagatgacttatcatttgatgatttataggaggcaattttatgaaagtaattatgatttatgatcaaattcaatctggtgcaggaatcaaagatgaccatatgattcctttaggagctaaaaaagaaccggttggaccagcaattatgatggaacaatatttaaaaacagttgacggacgcgtgatggcatgtttatattgtggtgatgggtattatgaagcaaatcctgaagaagttagtcgtaaactatgcgcgatgattaataagttaaaacctgatgtagtaatgtgtggaccagcatttaactatttaggttatggcaagatggcagctaatattgcctatgatattaatcagacaacagatattcctgcatttgcagcaatgtcaaaagaaaatgaagaaacgattaatgaatttaaagataaaattcatattattgaaacaccaaaaaaaggtgggattggcttaaatgaatcattagatggaatgtgcaaattagcgaaagcattagttgatcatgaagatctaaatccgattacttcaaagtattgtttctaaactaaaaaggatgcggataacgcatccttttatcaaaaaataaaggaggaactcttagatgtggggtattattgcaacatggcgaatggccgtagaaggaatcagtaaagcaagtcaagttttagcagaaggtggtgacgctggtgacgcaatcgaaatagcggttagagaggtagaggactttccgtactataagtcagttggatatggcgggttgccaaacgaagaaatggaagttgaattagatgcggcttttatggatggtgatacattagatattggtgcggtagcggcaatcaaagattatgcaaatccagtaagtattgcaagacgattatcaaaagaaaaagtgaacaatttgttagttggtgaaggcgctgaaaaatttgctcataaagaaggttttgaaagaaagaatatgttgactgatcgtgctaaaattcactatcgtaatcgtgtaaaagaagttcaagcattggaaattaaaccctattcaggacatgatacggttggaatggtatgtttagatactcatggtaaaatgacttcggctacttctacaagtggcttatttatgaaaaaagctggtcgggtcggagattcaccgatttctggatcgggcttctatgttgatagtaaagtcggtggtgcaagtgctactggcttaggagaggatgttatgaaagggtgcgtagcttatgaaattgttcgtttaatgaaagatggaatgcatcctcaggctgcttgtgaaaaagcggttaatatgtttgatttagaattaaaagaacgccgtggtcaagcaggtgatatgtctttggtagcaatgaataataaaggagaatggggtgttgctacaaatattgaaggattttcatttgctgttgctactgctgaccaagaaccaattgtttatttgacagaaaataaagatggaaaatgtatacatacggtagctagtcaagaatggttagataattatatggctacaagaacagcccctttagaagaaaaataagatggaagatataattttaaaaaaagttgatgatattgctgaacaaatgattaaaagtattattgaaattgtaaaaatcgatagtgttgaaacagctcctttagaaaatgctccatttggctcaggggtcaaagcagctttagatgctactttggatttagctgcttcgttgggatttgtaacaacaaatattgataattatatcggatatgcaagttatggtgaaagtaaagattatatttgtgctattggtcatttagatgttgttccagttgggacaggctggaaacagcctccgtttagtgggtatgtagaagatggggtgatttatagtcggggaattttagataataaaggaccaatcttatcatgtctatttgctctttatgcacttaaagaattaaaacttgaattagctcatgagattagaattatctttggttgtgatgaagaatctggttttgaagatttaaaatattatttaagtaaagaaagaccgccgttaatgggatttacaccagattgtaaatatcctgttgtttatggtgagcgtggacgggctataattaaaatatgcgggaaaaaggatagattaaaagaattctttgatttggtcaataattatattttaaatgctaaaaataatggcgaaaggtttaatattgattttcaagatcaagaatttggattattagaagttcgaaattatcaattagaattagacggagatccaagtattcaatttagtgttagttatccagcgagtgtcacagtggaaacaatagtcaataatataaagatggtagttagcaattttgaagttaatttagtgggaaattatgatcctgtaaaattcccgctaaaatgtaaattagtaaagacattagtccatacttatgaaaaggtaactggagatgatggaacaccagttactacaaccggtgggacatatgctaagttgatgcctaatattgttccttttggaccatcatttcctggtcaaaaaggaattggtcaccaacctaatgaatggatgacaattgaagatattattacaaatgctaagatttacgccttaagtttatataatctagcgaaatgaaagtagggatgcagagtgattgaaatatgttgtggaagttatgaagatgctctaaatgcatattatggtggagcaaaaagaattgagttgaatagtgccttacatttaggtggtctaacacctagcattggttcattaaaattgacaaaaaatactacaaacttaaaggtaatctgcatggttcgaccacgtggagcgggattttgttatacagatattgaatttaaacagatgatgatagaagctaaggatctattagaaaatggagccgatggtatagcctttggatttttattaaaaaatcatgaaattgatattgaaagaaccaaggaaatggtttcactaataaagtcttatcaaaaagaagcggttttccaccgtgcttatgattgtgtaaaagacccatatgccagtattgagatattaattaatttaggcattgatcgcttgcttacgagcggactacgagctaaagccgctgatggtaaagatttaatcaaaaaattacaaacaaggtatggcgataaaatagaaatattagctggaagtggaattaacagtacaaacggacaagcaatcatggaatatacaggaatcgctcaaattcattcttcatgtaaagattggcaaaatgatccaactacaagtggagaatttgtaaactattgctatggaccggcagagcataaagatgattttgacatggttagtaaggaattagttgaaaaattagtgaaattaggattatgaaaaacaaactctggtttcgatatctaataacgattgtagcagtaattgcatcttcttttttgcaaacatacgctatcaaagtttttgtagaaccagctaatctgttatctagtggttttactggtgtagcaattttaattgatcgaattacttcattatatggctttaatttttctacttctttaggactgattgttttaaatgtaccagtagcaatcttatgttttaaaagtattggaaagaaatttgttatttcttctttgtgccaagtttttttaacaagctttttattaaggatttgtacattcccaccgttatttaatgatgttattttaaatgttttttttggtggatttgtttatggaatgtcgacagtaattgcattaagagggaatacttcatcagctggtaccgattttattgctttatatgtttctaataaaatgggtaaatccatctgggagtatgtttttattttcaatgccttgattctttgtatctttggttatatgtttggctggatatatgcaggctattcaattgtcttccagtttatttcaaccaaaacaatctcatcattttaccaaaggtataagcgggtaacattacagattacaacaacccacccggaacagataattgaaagatatgttaaagattatcgtcatggtgtttcagttgttaatggttatggtggttatagtaaaaatccaatgagtttacttcatacggttgtatctgcttatgaggttcaagatattgttcaattaatgcatgaatctgatgaaaaggcgataattaatgttattcctacggaaaatttctttggcggtttttatcaacgcccaattgaataaaaaacaactgctttatttagcagttgttttttttgagaataacttattttaagtaactttaacataacgatcaaaatgatctcctaaaaaactgtttagttcacttttaaatttgggagactggttgatgattcgctgatttccaatcataggattaaagtagcgatgtttagcatttattttataataacctgcttttttattatgactaatatcaacttgatgaaaatgacaaaaagcttcccatttatcgcttaattctttgtctttgcagatgtttttaatgacagaactttcattagtatataaatcatcttgtgtgataagcttttttgtcaacgcagtttttaatagattagctaaatattccatacaatatcgattttcatcagaggtgtaaacacgactgcattgaaacattacttttgtcaacattattgctttatctttacttttaaagataatttcatcttttttatcattaattattaaatcgtaataaattgacttaatttgttcgactgataaaaaattataataatatgcgtttgcaagagtatattctaatcgatcagctgataatttaggactttcattatcggcaattggatatttatgataatcatagattagattaatatctatctcgtatttaagaaaaattttttgtaattcacgactattaaaaatcatcttttttgtttcagcttcagtagactcttgtttttcataatcattattcaagaagtcaataacatgagcgaatacaggggtggctatatcatgtaatagagctgcaacagtagcatgcttatcatgagtaaaatgataagttattaaagaaacgccaatactatgatcatatcttgaaactccaaaactatttttaaatgtttgaaactgtgtatattccattccacaattcattccaatatctttgaggcgagtaaagatatttgtgttcatgatttctaaaagatacggtggaatcgtatcatgatatattttataaaacattattatctctccctgtgttaattatagttgctcaaagggatcatatttaggaagtgatgatccaaattcttttaatgattttataagactattaggactccattcaatcaaagatataccatcaaattcatgaacgccatctaagtcaatacaactaaagtgccattcaacaatagaatgtttattagtgtgaataaattgtttaatttcccacttatctaatttaaagtgttcgtgccagtcattgaaccatttttttatttcaatgattcctttgtattcaggaccccaagattcactataataagcatcggattcaaaaatcacttcaaaattattccaatgggaatcaaaccatgattgaaaccattcaattattagatcttctttcataaaaattatcctttctaaattattaatagtacttaaagtatagcattatttgtgatactcgtcattttcttatctaagtccaaagcaaatatcttcaaagtttttggggataaagttttatatttaatgataactaatgttttttataatttaaaaatagtttttacctttagtaattgttagtatggtataataaagatagttgaaatttggagtaaaggagtgttaacaatgggttttgatgattttaagcagctggtagataatatgcaaattaatttatatcttacagatattcaaacaaatgaaatcatttttatgaataataagatgaaagaaacttataatttgaaagatccagaaggtaaaatatgttggaaaacacttcaaaataatcaaagcggaccatgtccattttgtccacttatcaaattaaaacaaattaataatttatatcagtcgattagctggcgtgaaaatagtgatcttactaatcgtatttttgaaaactatgatagtttaattaaatgggaaaatggtaaaattgttcacatgcaacagtcaatcgatattactgattctgaaatcctaagtcaccaggctagtattgatgacttatgtggattattaaatcgtcgtgctggaaaagaaaaactgctcgagtttatggtgaaaaagaaaaaagctaaagaaagctttacaattgctttattagatataaataatttaaaaagagtaaatgattcttttggtcatcaagaaggagattttttattaaaacaaattgcttatgcagtaaagcaggatcttgataaggaagatcttatctttagattaggtggagatgaatttgttctagtttttgggcataaaaatactaaggatagtgctaaatttttaattgagaatcaaaaaaatatacaaaagctgcaagctttatacaataagccttacggattttcatatgcttttggaatgtatacagttttaccaactaataaattgactgttaatgatgtgataactagagcagatgaacaaatgtatcaggaaaagttgcgatatcgtcgaactcagttagcagaattggaagatgtttcagtaggatctactaatgtagcttgttttcaatatgatccaacacaactttatgaagctttgatcaaaagtaccgatgattttatttacatatgtaatatgaagacaggtatttttagatattcaccagcccaagtaaaagtttttaatttaccaggagaaattattgaccatcctttaccattttggaaggcaatcgtacatccccaagattgggaacgtttttataaatcaaatatggcaattggcgaaaataagatggattatcattctgttgaatttcgagcgatgaatagtgatggtgagtatatttggttaaaatgtcgtggacagttaatgcgcgatgaatttggtgagcctaatttatttgctggaataatgacacagttagaccgtcaaaataaaattgatcccctaactcatttatataatcgtcaagaatttgcgaaagcttttgagcttaagactaaagataaagcaatcgataatcttggaattatggttattgatattgatgactttaaaaacattaacgaaatatatgaccgttcatttggggattttattattaaaacagtagcccaattgactcaggcagttttgccaggtaatactagtatttataaattggatagcgatcaaatggggctgttgattgaaaatagtaccgaattggaaattactaaattatataatgagatacagaaacaattattgcatgaacaactattaaaacgttataaatgtccgattcaaatttcagctggatgtgcaatttatcctaaagatggattaacatataatgaactaaataaatatgctgattattcattacaatatgccaaggataatggaaaaaataaattaactttcttttcaaactacatccttgagcataagatgcgttcattagaaattttaaaatatattcgtgaaagtgtaagtgatgattatcgtggcttcgagttaaattatcagccccaagttgaggtgagtagtaaacaaatcaaaggagttgaggcactgttaagatggcagtgtcaagaattaggaaaagtatcaccagttgaatttattcccattcttgaagagagcgggctaattatcccagttggtctatgggttataaagaaagcaattcaggcttgttcgaagtgggtcgtatatgatcctgaattttctgttagtattaatgtatctgcgcttcagatgttaaatagtgattttgtggaagatgtaaaaaaggttctgaaaaaagaaaagctggcacctaaaaatattgtcttagaattaacagagagctatatggttaggaacatggatttactaagaacaatttttgagcagcttcgcgaattgggatttaaaattgcaatggatgattttggaacggggtatgcctcattggaaattttaaagactgttcctgctgatattgtcaagattgaccaaacgtttgtacgtgatattaagattagtaaatttgataaaacttttattcgttttattgctcaaatttgccacgatgttgatattgaggtattgttggaaggaattgaaacagaagaggaatttaatgttgttgaaccgatggaattagattatattcaaggattcttgtttgggcgtcctcaaagtgaagaagaaattacgaataagttgatataaattaaaaatgctatgttatcatagcatttttaattttgcgtatttaatccatagtaataggagataatttcagaaaaataatataacataatacgattatcaatttgaataatagaatcgatactgctaattggtaaggaaatcgaaggtaaaacaaatgctaaatcaactagaggtaataattcagaatcaccatcaatcgtgattaaaactatttttgcacctttagcagaagcttctttaataaagttttcataagtataagtagaaccagaaacactatagataatacaaagataatcttgattaatagagttaattagataggtaagctgaatatcctcgcgtacactttgaataaagcgattatgagagtataaagaatattctaactgactagcagcaaaataggtattgttgatcccaattgataagacatgtggatatttgtcaatcaatgatgctagttcttttagttgatgatcataatctagagcaccaagttctaaaatcgtattactgtattcttgagaaatctgactcagtaatgattcgttgctgagttttttttcatcgttatttttaaaactttcttcaacagaatatttgaattctgagtatccacggtatccaagcttttgatagaaacgtaggattgcagacttagaagtttcacaaaggtcgcctaaaacaacaatggagttattaacgatttgaggatcttctaagatacgagcacaaattttacgttcactaggtgtaaactcagtataatgaatggcaactgtttttttaaagtccatattaatacctctttttcttatttataattatatcgataaaccaaattaattacaatagagaaaattctcataacaaaaaataatattgataaatttctcaacagtgatataattgcaatgtaaacgcttttacacaagagggcttttggacattatccggagatgtctaaaacaaaaaaggagagaaaaatgaaagataaatttactgcactgatctgtaaagtatcaggaaatcgctttttaaatgtattgagggattcttttgtattggttgcttcactgacattaattgctggatttgcaattatgatcagttctgtatttattgatcccaatgggattatttttggttcatctggacttggtctaggggagatgatctttggaagtgagaaagagttcttagcgtcaggatttgctcaaatgctagtacaaggacaaaatatttttaatttttttagtaaaggggctatgtcgatcaacgctctgttgattgtggtgattttttcatataatgtctcaagaaaatattttagtgataatcgtgagcatatggtttcagtgatgtatgctttagcagcattttttatttgtttgccttgggattttaattatacaagtgctaagggaattgaggtcgatattaatggaattattaattcgaattttttaggtcaacaaggaatcttttttggactgattgttgcaggtagtgctacatttatatttaataaattatctaagttaaatatttcaataaagatgccggattcggtacctccagctgtagctcagagttttgaatctttagtgccggggatgttgacattatttgtctttattattgcaaccgttattagtaatacttttgctggtgaatcattaccggagtttattttaacaacgcttcaagcaccagctttagcaatatctaaaaccgcagcgtttgctctagtttcccaaattacatggccattattccagtggctgggaattcatccaactgctatttggggagcaatttttggaatgacctgggatattgctggaaacgaaaatgttttaggtgttgctaaacatttatatacaacgatgtttatgaattattcaactattgcagcgggaacatttgctttagcaccagtattatcgatattatttttctcaaaactaaaacaaaataaaaagattaccaaagtggctttagctccagcaatttttaatattagtgaaccgattacatttggattaccaatcattttaaatccaatctattttattccctttattattgtgcaaccattgtgtttctatattgcggtattttttactaagattggttttatcccagtagtatgtaataatgttccttggacagtaccaccgattatttcgggaattttgtttactggaacaattgcaggcgggttagtgcaactaataaatctagttatatcaatggcaatatattacccatttgttaaaatagctgataaaatggaattagataaaatgactgaaaccgagaaattagaagcggtggagacaaaaagagtaagtttattaagaggcagaaaaaatgaaactaagattagctgaaatctttacatcgagaatggttttgcaacatggcaaagaaataaatatttttggaaccggtgaaacaaatcaacaagtaactattactattcaaggacaaaccgcaacaacaacaataataaataataattggttgattacgctgccggcgctagaaataagtacggatgaaacattaatagtttcaactggattagaaactattacgttatcaaatattttaattggagatgtttattttttagcaggtcaatctaatattgaatttaaatttaaagattgtgattcagtaaaagttgatcaggaagtatgctatgatcgatatttaaggtattatgaagttccacaaattgaatatgaggatgaaaatatcaaaataccgcccattagaaatcaaggctggcaaatatgtgataatcaaacgattaatgatttttcagcaatcggttattatcttgcttattatttgcgtcatgatatagacatcccaatcggattaattgcagttaataaaggtggtacatcaggttcttgctggataaatgaaacatatcttcaaaaaaatcaagaaatcaaaaaagtatactatgatgaatattatcaagcaatcatgaatcaaacagaagcacaagaagatttagaaatagctaaatataaagagcgtgttaagcagtaccagcaaaaagtggcattatatcagcaaacttatccagaacgtaatatgagccagttaaaaaaagatgttggacatacaccatggccgggaccgcgggggaaaaaagatttttgtcgtccagcaggactatattacacgatgtttaaaaaaatctgtcaatatagtggtaaggcagttatttggtatcaaggggaagaggatactaaaaatgcttatttatatcatcaattgctacaactggtgattgaaaattggcgtgaagatatgaaagctcaaattccctttattattgtgcaattacctgaatatgatgatgataagaatgataactggcctattttaagagatgcccagcagcaggtttgtagagaagtacctgcttgctatttagttgtaacaatgaattgcggggaagaatttaatatccatccccaaaataaaaaaacagtcggtcatcgtattttttggcgaatcaaagaacttttttatgataatcaatttaatgggcattctccgaagataataaatattgaaaataattctaaaattataattgagtttgatcaaaaattacacagtagaggtattaataattttattttagaattaccagatcatcaagttgagacagttgggataattaaagaaaataaactgctggttgagcgacctgcccaagttagaacaattagttatggatatcaaaattattgtaagataagcatttttggagaaaataatttacctattgcaccttttaaaatacaattaactaaataatctgtcatttttatttaagagcaatgatatttgtagtgtcctaaaaagttagggtaactttaggcggtcactacaatcggctctttttctttttagttcagcaaaaagaaaaagaatttcagaatcttaaattactatttaattttattcaaaaagtcccctataatcgcataattgtgttaaaatgacttggagaaagaaggtggtaaaaaatgaaagtcgagcctgtaccccagtgttgcgatagtctagaggatcatttaccactaagatcaggtatctaatccccaataaaggaggaaacttatgatcgatacaattaccagcgatgagctgaaggatattcttttaaatggaacgccagaaacaataaaaaaagtaataactaatattcatccggctgatattttagatattcttcatgaagacgaggatagtattaaagcattaatggacaatcttcctaatgatgttgttgccagcattattgaagaggaagatgatgaagatgaccagtatgatttactgaaattattttcagatgctaaacaaaaagaaatcttagatgaaatgtctaatgatgaaatcactgatttgatcggtgaacttgaagaagatgaaaaacaggctatcttagataagatggacaaagaagataaagaagatgttgagcgactgttaacgtttgagcctgatacggccggtgggattatgacgacggaatatattagtattcgtgcgcgcaataccgttgaaaaaactttaaaatttcttcaagaaaataccgaagaagatacaacttattatctttatgtagttgatccacaaaatattttaaagggtgttgtatctttacgagatattgttactagctcgtttgatacagctatgctggatattactaatacaaatgtaaaaactgtattatataatgaagatcaggaagaagtagcaaaaaaatttcaaaaatatggatttatcatgatgccggtagttgatgaaatggaccatttattaggagttatcgagtttgacgatattattgatattattcaagaagaaagtacagaagatattaatttattagggggagtaaattctgaagaaagactagattcatctgttggagaatcggtcaagagtcggattccctggttgattgttaatttatttacggcagtaatggcggcttccgtggttagcttttttgaaggaacgattgctcaagtagttacacttgcaactgttatgccaatagttacaggaatgggcggtaatgcaggaactcagtctttaacaatcgttgtacgagggctttcattaggtgaaatgagtaaagagaatgcaacctggatcatgttaaaagaagtagctgttggtttttgcagtggtgtgataataggaattatagttgcgttaggctcaatgttatttgaaggaaatccagtttttggtttagtaacgggattagccatgtttttaaatatgattttagcaaatattgcgggttattttattccggttattttggaaaaatttcatattgatccagctctagcaagcggagttttcgtcacaactgtaactgatgtattgggatttttctttttcttaggattggcaacagtatttttgccatatttaatttgaggtaattaagtatggaagtaaaatatgtgaaaaagaatattgctaaaatcataattagtctatttttcattattatgatgctgtttggagcagcttttgcattgatttggtttaaacatatttttaattatatgacatgtttgattgttgcgatcgtggtttttattgtaattattattcttaataaaaaaggacaaatttgtcgcaatgttgaaattggtgaacaagggttagttgatcatttgggaaccttggagtatcgcgagataaaaaaagttatttatgataataatagaattgaaatgaattatggttttgctaatattgtaacaaaataccatgaagttttgctcgataaacttcaagaacaaggcgttacaatgattgaatataatggtcgtcttattaattttgaaagagtttcacttttaattatttatggtttagggatatatttcttttataatttatttgttttaatttttggaataatttcttgcttaaactataactatgagattattaatagtcttggcatagttgttcgagttttgaaattaataagtattttgctagcactatttgtatataaccggttaaaaaataaaaaagcaacagtgatcattataattgtaattattgtaggatttattgtatggggacagtctgttaaaataaaaacataccatgattattatgggaagtttgcttgtatcatgaaagaacgtgagttaaatatttataaagatattatcgcagaatatggaattttagataaaacgattaataatttagatagttataaagttgcagatttaaccaattatgaaaaagtaattgtgtatcaaggaacgaatatatcaggacagtatattgtccatcgagatgtaaaaaataataattcaaaagagcagatctttgcttattataatgggaaaacttttactcacggagctttgcatataacttttaatgatggtaaactagctattatagattacaatggagcggtttatgattatgataaactaaagctggttaatggttatattctcgaaatatataaagataatgaagtgaaaaagtgtttaatttttaattattttaaaggttatgatgatgacgaatatcgtcgttcttgggaattggttatttctaatcttaatgatggtaaacaaaacttgtatattttaaaagattcagatgatgaaaaggtaagaccacaaccaaataataagtctgaaaataaaatagatgcacaaactgaaacagacaatgtagttagtgatgagattaaagtaagtaatggtgaaaagttgataaaaaagatggatagtattaatattacagcctttgaatcaaatgaagattttgttaaaataaaagctgacagtagtgattataatgaaattgttttagaggtggcaaaacaattcacaattataaataatactgataagaaaatagatacacaaattctagggattactataatgtctggcagtcttgaggaatttggtgttgcaacaaatgatcgccaagatgttgaagatattggtaaagttaaaaatacttattactatcgaattagaaaagttggtaattattatttggcagcccgagttggtgatgattgtagtgtcaatgttggattaaccatgctagagccagtgattgcgacagatacttcacaaacaacagattttctttatcgaattgatggtaaaaaatatttaggaaatcgatggggagatataggaggatagagatggaagaaaagttagatgagatgattgtgttattaaaaaatattgataagaatttacaaattttagttgatgaaaaaaatgcagtaaaagtaaagaaaccaagtaatgatgcaatcttaaaacaatttgaagaaactgaaaaattatttaataaagtaatgaataaaggtaagtaaattataagcaattgctgtaattagtgcagttgctttttattattaaagaagatagctgtctgtttaatatgtttttgtagtcaattagggataaaaaaacaaaggtttttaataaacctttgctttttatatttctataattatttaaaactgtatgtgattatcttattgctttgctttttttaataacagttactaatgcaaataatgataaacttgcaacaataacaaatggtgcaatcattgttgaatcaccagttttaacacttgtagatgttgatggttgagttgctggtttttcagtatcgttaggagtatcactaggattatcagtaggagtatctggctcttgtagatccaaacgaattgtttcaccagtttctaaatcacgagcatatttactcataaattcccacattaatttagcatctggagtatagttccaatgtccccaaccataaatacgagccatgctgatttctacacctttggcattttcaattgcaccaacatcgattttagcaatattttcagcggttggctcaattgtatagcgttttgtccaaggaacaccatatagatatgcatcttcatctttgatgtcttcaacttgagtaacttccatatcatttaattcttgataaagttgagctacttgtaatcctgcatttaattctgttgtatcaaatgcatctttacaatattcatcaccatcaccagtgaagaaaataattggcatatcatatttatctttattagcagcaacagcttctttatttaagtcacttgcaccgaatggcccggaatgaccagctccagcagcaaagtatttagcatctgatagaccggcatttgttgtatttctacttccggcagataatccagaaatataaattcttgattgatcgatctgtggatatttctcttcaatgatctttaacattgtaataacatctgaatcaggagtttcattagaatcatcagtcattggatcgtatgtatatccttgatatgtatgaccttgccactcaggacaaattaagattacaccttcttcacttgctatttgtgcccatcctgaagtatcatattgagttctaggatcatttgtattaccgtggaatagaataactactgggacacttcctggttgagcatctttagattgttcaggaatatattcataccataatgaatcagtaccatctttatctaaatcttgagtaactacatgacgctcaatattatcgattgcatcaacagaatcaaaatattggtattttcttgcttgatcagcttctttatcaccagaaagtaatggtctagagtaccaagttgctgtttgtttatagacttcactatagttaccaattcttccaaatttttctaaaacagtattccatgcatcttttgttgcatcagcagcacttgtttttgtatcgctattaacaacaacgatttcataatgactttctgggttttcataatatccatcttttaccttaccagcattatttgcttttacataactattgataacagcttgatcatcagttactaagtaagtaggaacagatactttaacttcttgcccttgagctggattaattaaagcaagcccagatacaaagttcatataagatgttaagttttgattaatgaaagttgctccatcaccaatcccaattaatttaaagttatttgaaacaccaattttacctacgattgtttcaaaacctataacatcatcatcagtaaaagaaatgccattagcaggtctagcaacataaactttgcttgctgcccgatcaacaatatcttttattcctgattcattaatatatttttgtgcttcttcatctgttaaatttccatcaggataaacaacgaaagttgcagcagcggcagcattgactgattcaatacttaatttatcgctaccactgtaaacataggcttcgctcatttcattaactgaggccttgtaagcttcaacatactttggtaatgtatctattttagcctttgcaccattgcttgaaagctcaattgcatcaggcgcccaggcaacttctggataaggttgtgaaatagttgtaccatctaatagaccgctaataacttgtgccatatcgttgaaatattgaattgacatttcgttaggtctttgggcattgtcttcccaaaattgttgccagcgatgaccagctaaaatagatagagaaggattttcatttaaaatagttctagctaaagcacatccttcgtttaaagcagcaattgggtttccaccatttgtttcaaaaagtgcccaaataaatccactgccaaatgtatcaccagtaaataatgctccatgagtggtatctgtaatcataagagagccttcggtatgagcactgacaacattgaatacatatggggcaccataaatgttaacagtatcaccatgattaacttttgtgattttactatcaaattgagtgattgcttccgcggcagcagcataatcaggttcactgatatatactttttcaacgtcaacgtctgcgaatactgtttctgatcgtccaaagccagtatgatcaccatgactatgagtaataataattgataacggcttatttcctgtcattgaatttacgattgtttttgcattttgaatatcttcatcgttttcagagccatttcctaaatcaactaataatacaccgtcttcttctagtacaaaatacatagatgatgggttatttgttacgccgctctcatctgttgcaccaccaggaagtttttttgttccctcatcccagtgataaatattatccttgattttctctactttgtaccttcctaattcagcatatccatcatcagtaagatctgttaaaaatgcatttccatttggatcaagttctactactttagatgctgttgatttggatccttggtctccttcggcctgtaccgcaccaataccacttaatgcgaacatcaggcttagggaaccaataaaaaattttttcttaaacatttcttttttccctccttcattataaatattttatcacagcggctttatgaaagcgattacaaaaactgatggtaagtatcataatttgatacctaatatcataatttgattgatatttatacaattaaatatgatataatcattaaataacttacttatttataaattaaaactgttaaatagaaactctacactaataacgatatttagtaattatatgattgagacataggatttatcctatgtctttttttgttttaaaattatcgtagcgaatctttctaactaaaaaatgagataataataacttacatctttgtaagataactatgtaataaaaaataattgtgtataataaaaaagaggagatcgttatgaaaatattaattattgaagatgatttagaattacgagaagaattaaaagttttattagataataatggttaccaaggaatcattctaaaagattttaaaaatgcgttagaagagattttagtaatagatccagatttgattctattagatattaagattccatttttgaatggacagcagctattaaaaaaattaagagaaaaatcaactattccagttattatggttacaagtaaagatagtgagatcgatgaaattcttgcattaagctatggtgctgatgattatattactaaaccatataatccaacgattttattactgcatattgaagctgtttttaagcgactccataaagctgaaccaaaactgacttatcaaaatattagggttaatttgatgaaaagtacgttagaaaaagatgatcaggaattattgttatctaaaaatgagatgggaattttttattatcttcttatgaatcaagggaaaatcgtaactcgtgatgatattatgaattatctatggggtacggataaatttattgatgataatactttgacagttaatatgactagactaagaaaaagacttgaaaagattggcctttttgatgtgattgaaacaaggagagatcaggggtatatgttaatatgagaataaaagaatacttactagatagactggcctatctagttttattaataattatgattgtgagcgtgctattcttcttattgatgtttaaagtttcaaatgcattaatttatgctattgttttagttatgcttttatttagtggtttgcttattggatatgattattatcaaaaacatgctttctataataattttcgcattaaattaaatcaattagataaaaaatgtttaattacagaattgattgctcagcctgattttctagaaggaaagattttatatgatgcattgtatgagattgataagtcaatgtatgaggagattgagacttatcaagataatcttaagaattttaaagaatatattgaattatggattcatgaagttaaattaccaatttctagtgtaaagttgatgattcataatcatgaacataatgaaagaaaactaaaggatcaagttagtcgaattgaaaattatgtagaacaagttttatattatgcccgacaagatagtagtgagaaagattatttgattaaacaatgtgaattaggaacaattattagaaatgttattaagaagaaccaagatagtttattgtatcaaaatattaagatcgaaatcggtcaagttaattgttctgttttaagcgatagcaagtggctagaatttattattaatcaaattgttagtaatagtattaaatatcggcgtacagataagtgtaaaatagcttttaatgtgattagaaggaataatattgctttagaaataattgataatggtctgggaatcaagactagtgatctaacgagagtatttgaaaaatcatttactggtgaaaacgggcgtcttgtttctagttctacggggatgggcttatatattgttaagcgattatgtgataaattaggtcataagattataattgaatctaaatatagtgagtatacgaaagtaacaatttcttttaatgatgagcaatattacaaggttgtaaggtgatgtaagttatttcgatgttaccaagaccgccttttttctataatttaattgtaaaggagaaaagattatggaaaatattctaacgattgaaaatattagtaaatattatggaaataagagtaatcttactaaagctatcagcaatatttcaatgaatgttgataaaggtgaatttattgctatcatgggggctagtggttcagggaaaactacactactgaatgttatttcaactattgataaagttacaagtggtcatatttatattgaaggtcaggatattacaaaacttaaaggtaacgatctaaataggtttagacgtgaagaactaggatttatttttcaagattttaatttattagatacgctaacagcttatgaaaatattgctttggctttacaaattcaaaattttaaagctaaagcaattgaacagcaaataaaagttgttgcaagaaaattagatattgaagatattttaaataaatatccttatgaaatgtctggaggacaaaaacagcgtgtagctagtgcgcgggccattgttacaaatcctaaacttgttttagcagatgagcctactggagcgttagattctaaaagttctaaaatgttattagaacgacttcaaagattaaatcaagactatcaaacaacgattctaatggtaactcatgatgcttttagtgccagctatgcttctaaagtgatttttatcaaagatggaaaggtctttaatcaatttaatcgaggtgaagctactcgtaaacaattttttgataaaattattgatgttgtttctttgcttgggggcgatgtaagtgatgttatttaatctttcattaaagaatattagaaaaagttttaaagattatgcaatctatttttttacattaatccttggagtggcaatcttttatatcttcaattctttggaaagccaaacagttatgctgaaactaaatagttcaactaaagatattattaaactaatgaataatgtgttgtcaggcgtaagtgtatttgtttcatttatattagggtttttaattgtctatgcaaatcaatttttaatgaagcgaagaaaaaaagagtttgggatatatatgatattaggaatgtcaaaaaaacagatttctaaaatactattagttgaaactataacaattggtttgatttcattagtaattggtttagtcttaggagtcgctctatctcaaataatgtcgattgttgtagctaatatgtttgaagcagacatgactaaatttacatttgttttctctttaagtgcgtggataaaaacaatgatttattttgggattatgtatcttctggttatggtttttaatacgattcaagtgaatcgccaacaattaattaaattattgacagcaaatagacaaaatgaagaagttaaattaaagaatacctatctttgtatagggatctttattggtgctgttgtattattaagttatgcttattataacgttaccgcaggagctggtaatttaacgaacagcagctcagtgcttttccaaatgatttatggtgctgtcgcaacgtttttaatctattggtctatttcaggtttgattttaaaatttgttatggcatctaaaaattattatttcaaaaatttaaatagttttacggttaaacaaattagtagtaagattaatacaacagtactttcaacaacggtaatttgtttaatgctttttttaacgatttgtattttttcaagtgcttttgcgttaaataattctgcaacagaagagataaatgagttagctccagttgatattcaaatgcaaaaagatgtaagtgttgataatttatcaattacaaaatatttgtctcaaaagcaaataggattagatgatttaaaaaacatttatacatttatgacttatcgtacttcacaattgacatatagagatacttttggcagtgcctttaaagatgtaagtgaaagttatttgaataattgtgaagatattattaaacttagtgattataataaattggctaaaatatataatttaccaacttatgatttaaaagacgaatatgttgtaatggggaattatgaaaatttaatgtttagtcgaaatcaatttcttaaagaaaaaccagctattgagttaaacggaaagatatatcagagtaaatttgataaatgtcaaaatggttttttatcaatgcagtctagtcatatgtgtatgggagtgtatattgttccagatgaagcggttagtaattttattcctgctgatagttatttagtgggtaattatgctgcaaatgatcaggatacaagaaacgaagtagatgaaaaaatgcacagttatagctctgatgtcttattgattaatacaagaattcaaatttcaagtagtagtgtgtctatgggagctatggttatctttattggtttatatataggaattgtatttttgatttcttgtgctgctatcttggcactcaaagagttgtcacaaagcattgataataaaggaaaatatcagattttaaggaacgttggtgttgatgaaaaaatgattaatcgttctttatttaagcaaatagctgtttattttgctttcccgcttatcttagcattgattcattcaatttttggtatccaggtttgcaatataatgctgcaaacatttaatcaggctaatgtatttgatgctattataacgactggaatctttttagttattatttatggtggttattttatcatcacataccagtgtagtaaaagtattattaaagataagtagaggattatactgacgaggggattcacttcaattttatatactagtaattgaggtatagattatatgttatgatgataacaagtaggtgataaaatgagtgagtttgaaaagatgagagcgggagaaatttataatccccgagatttaaaactgatctatatgtatgataagacagcgcggcgtttgcataggtataataaaaggtgttttcatgtatataatatgcgaagccgcttaatgaaaaaaattattaatacaagcggtaatttttggattcatccgccatttcaatgtgattatggctgtaatatctatttgggaaaagatgttatgattaattacggctgtgtgtttttagatgtttgtgaaattaagatcggtgataatactctgattggtccacatacccaaatatatactgcctgtcattcaatcgatccacaagagcgtttaaaagaaattgaatttgggaaagcagttaccattgggaataatgtttggattggtggaaactgtactattttaccaggagttacgattggcgataatagcgttattggagcaggcagtgtggtaactaaagatgttcctgctaacgtactagcttatggcaatccatgtcaactaaaaaagaagatatgattttataaagttcttaagcttttgctaagaacttttcattattcttgacatttgtccagcaatagtataaatttatatcatactaatacagtaggaaaagagggataggatgatttccgtaaagatattaaaaaataaaaagatttttgaatgggaacgaatgtatggctgttgtcataattaataatgttgttaaataaatttattaaggaaagaggacagttaaatgaatataaatatttttgaattaggagccgtgcttcttgcaggtgttttcttcgcaattatctattttctaggtaaagtgaagaagtatgattttgggcttttaactattttaggattagtttttggggtagccgtaggattgatttttaaaggacattatttgtatttagaagcaatcggaacgatttattcgcatttgatcttagcgatcgttatcccgctattattattcagtattatttcaagtattacaaatttaggaacatcgatcaaattaaagaaaataagtgccaaagcgataatatttttattattaaacaccctactagctagtactataacactgaccttagcagtagtaactaaagttggaagtggcataaattatcaattggcaagtgattataaagcggtggaagttccggcattcatcgatacgatcattaatttatttccaagcaatttggctaacagttgggtaaatggcgaagtagtacctattgtaattttcgctgtaattgttgcgattgcctacaataagattgcccgtaatcagcaaaaagctgttttaccgtttaagcattttatagatgccggaaatcgtgtgatgggagaggttgttaactttgttattagctttacaccgtatgctgtattagcattgattgcacgtgcagtaagcaagagtgctctaagtgatctgattccgctattgagcgtcttaggattagcatatttattgagtataatccaaatttttggggtaaccagtgttttattaaaggtggtaggaaagttaaatccgcttaatttctttaaaggaatttggccggctggggtagtagcattcacttctcaaagtagtattgggacaattcctgtcactgttagacaacttacaaagaaactaggagttaatgaagatgttgcttcatttgtagctagtttaggggctaatctaggtatgccgggatgtgcaggaatttggccagttttattagcagtcttcgcaataaatgttttggggattgattattcaatcggccagtatatatttttaattgttttagctgtagtagtatcaattggaactgttggggtgcctggtactgcaaccattactgctactgcattatttgcttcagcaggcttaccgattgaaattattgttttattagcacctatttcaagtattgtagatatggcaagaacagcaactaatgttgttggtgccgctagtgctgcaatgttagttgcccgaagtgaaaatgaattagaccttgctgtttataataatgaaacaatcggacagccggatttagaaataatttaaaaatagaagctatgaagataaattcatagcttttttatgttcatattttagtgaaaacaatctatctggaaaaataatcaagaatagttatttttctttatttgtataattttgacatttttatgattttgtttcatataaattattgataaagccaaaaatgagcatgtttttatataaaaacactggttaaagcggtataattggtattgtaatatgatatctattgtgatatattgtaaacagatattagatagaggcgcgaattgttaagaagtttttaccataagatgcaaaccaggtaaaaagggaggagcgttcgccgaagagataaatgattgcatgcgtttatcctctgggcttatagtgaagatctataagactgtcattatcaatagataatggtgagctatcattgttcatacgctgtttatgttgcaatgatactcattgcaactttttttgtaaaggagaacaatgatggaaaatattattgatgcagtgagctacgaagaaaatattattcaattacaacttagaaatgttcctaaacacccaatgattattgccaagatatttacaatcttgagtgagtgtggggtaaatgtagatatgatttctcaagtaatgattgaagatgcgatgcaaattgagattacacttgatgaaaaatatcaaaagaatcttaatgatgcaattatgagattaaaagatgaggttaagcaattagaaattgcgactaatcgtaaatattttaaaattgcagttgggggaaaattactagaaacgacccctggggcagcggctaaagtatttactattttaggggataacaacattcatttttatcaagtaacaacctctaaacgaacaatctcgtttattgttgataagaaacacaaagaattagcaatgaaaaaattagatgaagcttttggcttaaatatataggaggaaattatggctatttttgaaggtagtgcagtagcactagtattaccaatgcatgaagatggaagtattgattatgatggatttagacgtcaggttcaaagaatgcttgatggcggtgttcaagctttattagttaatggaactactggtgaaactgcaacgattcatattgatgatgaatttaaattattagatattacattagagatggcagcgggaactggtgtaaaggttatcgctggagcaggatcaaatgacaccgcaacagctttaaagaaagcacattatgctaaagaaaaaggggctgatgcaattttagttgtaactccatattacaataaaacaagtcagcgtggtttgatcaaacattatacgacagttgctgatgcagtagatattccaatgattttatataatgttccaggaagaacgggaataaatattaatgttgcaacagttgttgaattagctaaacataaaaatattgttgctatgaaagatgcaacagataatattgcatatgcaatggaagttttagctaaaactcaaggtatggattttgatatgtattcaggatgtgatgataatatcttgccatttatttgtgccggaggaaaaggagttatttcagtattatcaaatatttatccacgccaaactgaattgttggctcaattagcattaaaaggtgatttacctaaagctcaagaattggcctatgctcttgagccggtatgtcgctatttgttcattgatgttaatccaattatgcctaaagctgcattagcaagaatgaatgtatgtaaaccgacattgagattgcctttgattgaaacaaccgaagaaaataaaaaattattgtttgatgcgatggatgcatttgaaaagttggggttttaagatgaaagtattagtatatggatatggattaatggggaaaaggattgcccataaagtaagaagtcaaaatgatatggaattaatgggaattgtaagttatgaatttgatgaaaaagttcctgaaaaaacatatagttcattaaaagagtgcgatgaaaaagccgatgtcatcatcgacttttctcatccgaacaatttaaatgatattttaacgtatgcattagcgaatcaaacaaaattagtaattgctacgacaggttatagtcaagaacagcttgatcaaattaaagaagcatctaaagaaattgctatctttcaatcatataacacatcatttggggtgcagatggttacaaaaatgttacgacaattcgcaaaagaattttatgacgcaggatatgatattgagatccttgaaaaacatcataatcagaaaattgatgcaccttcaggaactgctgaattattatatgaagttatggctgaggaaattgatggcgtagaagcgtgttatgatcgcagcagtcgtcatgaaaaacgaaagaaagaagaaattgggatccagtcattgcgtgggggaacaatttttggggaacacacgattatgtttgcgggagtagatgaaattattgaaatcaagcatacggctttatcaaaagaagtatttgttcaaggtgcgattagtgctgcttatgcactaaatgataaagataatggtttatttactttaaaatcattatattaatagggggaaaatatggtcttacaaacggaatttgcacaaattaaaaataataacttatacatagatgatgttaaagcaacagagttagcaaaaaaatatggaacacctttatatgttatgtctgaaggacatattagacatcaatttaataaattaaaaacgaaaatgattgaaaagtatgaaaatacactaccattatttgcatcaaaatcattttcttgtattgcaatttataaaattgctaaagaatatggtgttggaatcgattgtgtatcagcgggtgagatttcagttgctttaaaaagtggatttgatcctaaaaagatttatttccatggaaataataaattaccatcagaaatagaatacgcgttagaaaacggggtagaaaattttgtaatagataatttttatgaaatagatttagtccaagaaattgcttcgagattaggtgtcaaaataaatgggattgtcagaatcacaccgggggtttatgcaggaggtcatgactatattcgagttggtgccaaagatacaaaatttggttttagcagccatgataatacatatctaaaagcaatcaaaaaggtaattgatgctccaaatattaattttgatggaatacattgtcatgttggcagccaaattgaagatattcaagcgtatgttttagcaatgaataaatttgttgaaattgcttatgaaatttatgatatttttggaattgtaattaataaattaaatgcaggtggtggttttggaattgcttatacagctgctgataacccattagaatttgaagcagtagttgatacgatcatggaaatcattactaaaggatttgatgctcggggattaaaacgtccgatggtcctagttgagcctggtcgttattgtgtaggaaatgctggaatcacattatataccgtcgggtcatctaaatatattaaagatattcgtgattatattacagttgatggtgggatgactgataatattcgttctagcttatatgctgctaaatatgatgctattattgcaaataaagcagaaatgccgacggatcacctaattactgttgctggaaagaactgtgaatctggggatattttaattaaggatattatgttacaagacccagagcccggagatattctggcaatgttttcaacaggagcgtatcattattcaatgtcatcaaattataatcaattgccaaaaccggcagtggtatttacgtatgaaggtaaggatcgtgaagtgattcgtcgccagacatttgatgatttagtttattacgacattgattcaaaatattaattaaagcggcatatgccgctttaaacatagatggaggaatttatggaattaacctataagaatattaaagagatttcgcaagagagattagttgatttatttaaatcggtagagtgggagtcagcgaactatcctgctcaattagtacaggcaataaaaaactatggaagtgtttttagcgcttgggataatgataagtgtgttggtctggttgcttcgatggacgatagtatcatggttgcttatgttcattatgttttagtcaatccacaatatcaaaaatatggaattggtaaaaaactgatgcaaatgatgctggaacattataaggactatcataaagtttgtttgattggtgtaaatactgctgttggtttttatgaacatcttggttttgaagttaatgaaaaagcaaaaccaatgttttatctgaataagaattattaataaaaaatgactttttaaggagtcatttttatttagtcttatttttgggcaattacacaaatagttttacttgttttatcatatttttgtccaatgacatctttataaaaatcaagcttagtaaagccggcattttttaagtctttctctaattctttcagggagaaagtatgttcccagatattataagtagttattctatcttcattaatgacagtatactgatttaaaaatgtatggacattatcataacgataaaaagcatttaaaactaagtgccagtcattatgccaaaaaccattttcatttatttgccaatttttatgttctaccgctccatcatattgtaaaggagtaaagacatcaaataataaagcgcctttgggggataatgtgttatagatcttttgcaagagctttttcctagtagcaggaggaaggacaccaaaatcacaataaattaaagtaactaaatcatagtgctgtctaaagttcgatttggtatagtcactacgaaggtaaataatatcaaatcctttttgtttggcggaagcttgagcataactgattgaccgttttgatagatcgataccagtaacctgataaccatactgatagaataattcagcataaataccggggccacaaccaagatcaagtaagttgttataatgatgattaggtagtacagtattgatccaggcaactgatttttttacaaagtcaagtttacgggtagctgattcttggttctcgttaagatgagcttttaacatgccttttgaaatatgagggtcgtcccaaatacttgctgtactttgttcaaataatttaggtcgcgtatttaattgttttaatatgtctttcatcgtgttttgtcctttcgtatgatccggtaactagataaaataaaaaactgtggttatttccacagttaagagttttgactattaatgtggaaattaaaataatcatttgggcataacaataaaacctgtttttgacaggtaaaaaattatgcatttttgattatctaagttttccacgtttcacttatgttactgattatgtaacatcaagtgcgccggacaaaatcatctccttaatagttaccgtaattaaattatatagtatttgtaaagtaaaaacaattaataaaagccataactgctatggcttttattaatttataatttgtctgttttaagacatagataattaatttcagcaggagttaatcttatttttaacgcctcagcacatgaatcaaattcacttttattacgactaccaacaatagctgcaacatcaaatggctggtcaagtacatatgcaagggcaatattgattgaaggaaccactttgagttttcctaattctttagctcgttttaatcgttcaaagttttctggagtaaagaaagcatctttaatgtcctgaggtgcgttatcatcgtaaatatcagcgaagaaaccgtgtccttgagcggcccagctaaatagagtaacatctttattttgatgccatttagcaaaatcgtcatctgcatagacacagccaggccaacgtgttttcgcgacatgggctaaagaataagatggattatttactgataatccttggtagcccatttgttggcaatattctactgccgcttgaacacgatctagttcccaattggatacaccataagtagtaattaaaccttcttgacgatgctgttctaaacgatccattatttcattgacagggacactaggatcatcgcgatgaagtaagtaaatatcaaaatgatcgcaccctgtatgaagtaaactataatgaagatcgtcagtaataatatctggctttactcgccaatactctggatgatggcagccttcaggggtaataattgggtgacatgctttatccataattactaattgatcacgattattacgagaatcaaaccatttttttaaaactcgttcagattcacaagcatgttctccatctttgtttgccccataaaatctacctgtgtcgattactgtttctccagcagcaacatattgatccagcattgtaaaaatttcttcttcaaaggctggattaaaccaggctgtacccataattaattttgaaatcggtttgtctaaacctttaatgttaatatattccattttttcatctcctaagcagtttttttgattaaataagtatttaagataagaccgatgattgcaacaccaatagcaactaaatagacattgttataggcaaggtgccggcttcactgttaacaaaattagcagctatctgaggtccaaatagagagtcgattgaattaggaataattcatacactatcatcacaatatattccagatacaatcagaggttatctccagcaatatccccaaacagagtttaaaattcaaactgataaaacagaaaatattattaaagggctaaaagaacataaatatgatataggtttttgtggaaaaataattgctccagaattagtttttattcctgttttatatcaggaatttgttgctgttgttccaccagatcacgaacttgcaaataagcaggagataagtttagaagaattagtaaactatgatttagtaggctatcttgatgatttagtaattgctcaaacagttaaagaaatttttgcagaacataaattggagccccgctatatttctaaacaggaaaatgaattattgattggtgggatgatcaatcaagggtttggtgtaggaatcgctgctaatacatcatttttaaaagaatttgatttaaaggtcattcctttaaaattaaaaaaagattaccgtgtaatctatctagtttataataaagtagattatatttcagcagctgcagaaaactttatcaactatattgcaattaataaaataaatttataaaaaattgctgaaatgcagtaactctttaatcactgtttaataattttgttgtctgtaaagctcttgctaagataacataaataataatgccaccagcagtctgcatagttagaccaggtaaagctccaagtgcagcgggccaagtaaataaaaaagtttcagttgctgtataagctataatttggaaaacgccaccaccaattgcacttattattttacttggatactgttcccaaataattcccatgatccaggccataatgaatttaataattaaagttggtccgatccagatagctgcaccacatagtaaatcggctaaagcacctcctaatgcaccagcaaaggcaccatctcttttacctagaatcaatacacttaaaaagatcatactgtcgcccatatgaaagtatcctccagtagctggattgggaattctaatactgaatgttccaacaaaaattagggctatcattagtgctgtttttgcgagttgatttgttttttcattaatcatttctaatccccctttagaattgataatataatagcaaaatattgaccatatcttaataaccaataataagatattttaaaaggacagtttaaattaatatagagaaaaagtaatctatgtagtgaccaactttaggaggtcactttttatatgaagtagagtaaagaacttaaattagaatgtatttaaaaacataaaaaatggtgaatgcataaaaggaccaccaggaattaaacatgaagtttttataattaagttcttcgctggtctaggatatttgattcacttggagaaataggattagaacatggaagagcaaccatatctgttgaacaaagaatcgaattgattaatagagtttaaaacaagagaacaactcaaagctgcaatgagtgaatatatcgaatattataataacgagagaatcaatacaaaaagaaaaggattgagtccacttgcatatagacaacaatcctttcaagatttagctttaatttaatgtgtccaactttttgggaatactacactaaatcacttttttctttggtttatttaattcctcatggataccttgcattttataatccagattagaaattgttttagcacattcaattagctcatcacgaactccatcaggaacttcattatcagctttatatcgcaagtgatgttctaaacttgcccaaaagtccatcgcaatcgttctaatttgaatttctacagtagttggctgaactttctctgctaagaagataggaacttcaacaactagatgtaaactacgataaccattctccttgggatgtttaatgtaatcttttttggcaataagtttaatatcactttgttttattaataaatcagcaattttatagacatcgctaacataattacaaataacgcgaacaccagcaatatcagtcaaattagttacaatagaatctaaagatacttctaggccccgtttttctagttttcccaatatactgtttacagattttaaacgatattccatatgatgaatagggttatgatcatgttttattttaaactcatcatcaagaatttctaattttgttcttacttctttaattcccgcatcataaagttgttgcagcgccataaattcttgtaaagtgtcagttatatctgtattaggaactagtgcggtaaaaggatcactgacaatttccttttgcataattcgattagtcataaaatacccctttattaaatattttttgtataacttaatcatagttggtaataatgaacttgaggtgaactagatgaaaaaaacaattgtagtattattaattatgatgaatattgtatcagtaaatgcttcaagtaatgacccaaaatataaaataattgccaatagtaatagtgataaagatattaagacaatgtatgaaacaaaagatgacttaattaaagactataaagattggattaaaagtgttgatgatgttgatcaagcactagctgatcatcaaaaagattatcaagctaagtattataatggagaatatacaattgtcctaggcgctggcaaaggaaaggaacttacgggtactttgaaggcaagttattgtgtaagtagtaaagaaattaaaaagaaatcattttttgcagaattattttcttaagattatcagtgaagcgaatccttctagttggttatatccaacttttggaactcactttactgatagtcttttattatgtcctaaatataactgaaatatgctatactatttaatagagtagtaatgaaaggagtcagagatgaaaacagtaaaagatgctgaaatcttttgtcaatatatagcccatgagtatcttgggaagcgtaattataagttattaaaagatataattgataaaaggattacaatcattgggacgggagctcacgaggttagtcgcaacattcaagaacttatgacggctttgaataaagaagcagaactttgggatggaacttttataattgaagatgaatggtatcagggaactgaattagctgataacttatttgtagtaattggccaaattgagggccgacaaaatagtaacgaccagttagtctatagtttttcatcacgagtaacctttattattgaatatcatgatatgcagtggaagattatccatgttcatcaatcagtaccggattatagtcaaggtgatgatgagtttttcccacaacggattgtcgaagaaagtaatgctcagttaaaaaaggaaattgctgaaaagacgaaggaattagagatgtccaatcaacaagtaatctataatttaagacatgattatcttactggaatattaaatcgtccatcacttgaaaaagaagttactgaagcgatgagtaatcatcagtatggagtgatcttagtattagacatagattattttaaagaagttaatgataataatggtcatccgtatggtgacgaggttttgataaaattagctaatacaatgcaagaaagttttaaatcaggaatttgtggtcgcattggcggtgatgaatttatcatttatctggctttagacgatgctaattatgatgcaattgaaaagactattaaagaatttaaacaaaattggcagaagaatattacaacaattgatagaagcagcacaattactttaagtatcgggggagcatattatcctaaacatggtaaaaattatcaagagttgtggtctaatgccgataaagcactatatttaagtaaaaataatggtcgaaacagaatatctatatatcaactctaaacagttctcgaaagggaactgttttatgtttaaaataaatcgtttcgttaataatttaagaggtcaaacatataataaaattagaggtggaacatgttaacaaaatttgatgaacaagcccaaaaagcaattgtggtaggcgaaagtattgcttttgatttaggtcataataatgtcggtagtgaacatttactgctatcgctgttaaagataagtgattccaaattacgggaattagttaagaaatatgatgttgatgataaaaatatatatgaggatataaaaaggttgtttgggacaaatgatgatcaacctttttatatggagtatagtgatgctgtaaaaagtatcttagaagcagcaatggaaatcactaatcaacaaaataaaagtaaagtaacgcttaatatcctaacaattgctttattgcagagtgaagaaagtgtagctcacgaattattaaagaaatataaagttgattttgaagaaattatctatcaattaaatgaaagtagtgaattagaaactaaattagatcagattcaatcactagttaatcttaataagaaagtaaaacagggtgaacatttaattgttggtagacaaaaagaattagaaaaattatgtatgattttaagtaagaaagaaaaaaataatgcgttgattattggtgaagctggtgtaggtaagtcagctttagtagaaaaattagcgtatttaattaatcaaaaacaagtaaatgaaggattaaaaaagaaaattatttatgaattgagcttatctagtattgttgcaggaacaaaatatcgtggtgaatttgaagaaaagctacgaaagattattgataaggtaaaagaaatggataatgtcatcatttttattgatgagatccataatattattggggctggtggcgccgaaggggctattgatgctgctaatattttaaaaccgtatttagcgagaaaagatctaacgattattggtgcaacaacgacagaagaatatttccagcattttgaaaaggatcaagcaatgaatcgacgttttagtgttattacactaaaagaaaatactaaagaagaaacattagaaattttacagaaaactaaattattttatgagcaatttcatcagattgaagtcgataatgaagttttaacatatttagttgataatgttgatcgttatatcaaaaatcgaactttccctgataaagccatcgatatttttgatttagcttgtgttaaagcccgatttaagcagcaacatattattactaaacaaattgttaaagatgttatagaagaatatacatcagttaagataagtgaggattatgattatgatgaaattaaagcaaaattgaatcatcatattattggacaaagtaaagcgattgaacaaataatcaatcaattaaaattaacaaaacagtcaaaacaaccaagtgcagtaatgttatttgttggaaatagtggtgttggaaaaagtgaaagtgcaaaacagctttcaaaacttttggggcgtaaattgattcgcttagatatgagtgaatatcgtgatagcagcagtgttcaaaagataattggagcagccccgggatatgttggttatgataaaccaagtttattactgggacaattacaaacctatcctaaaagtattattcttttagatgaaattgataaagcaagtcaagatgttataaatctttttcttcaagtatttgatgaaggttatttagaagatagtcataaacgaaaagtatattttaataatacaattattattatgacgtcaaataaagggactgctaaaaatacattaggatttaaaaagaataatcatagtagtaaagttaagaatttttttagtgatgaattattaagccgtatcgatgaaataattaattttaagaatttaacaaaaatggatttaaagaaaattattcgtaaaaattgtcctcatgaggttaaagaagaagatattgagttgattttaaaggaatatgatatgaaacttcaaggaagaggaattgttaaagcagctaataaatattttcaaaataaagcgaaggcccaaagttaattgagtcttcgctttttccataaaataattaatagtgtgatgattgcaataatcagtgcgtattgtttaacatatttactaattaagatccagttatttcctaaaataattccaagaactactaaaatactattccaaatgattgtaccaatcaaagtataaaatgagaaactaaagaagttcattttagtaattccggcaggcagagaaatcaatgatctaacaatcggaatcaagcgaccaataagaacagagatttttccatattgttcaaaccagttaagggaacgggatagatcatgacgtttaaaataaaatcggactagaagcttttcgagtcgttctagattgattaagtagccaaaccaatatagaatcactgcgcctaaataagaaccaagcgaagcaactgtaattacgcctagaggtgttaggtttgtgatcgttgtcatgaaaccgccaaaagttaaaattatttcacatgggataggcggaaataaattttcaatcgcaattaaaagaaagattgccttgtagccgtaggtgttaatataagcgagaaggtttgtgagcataagtgacctcctgttttgataatgggattactttattagccagatagatcaataagttatcaaatggtaatagaataatagttgaaatgatattaaagaaagtatgcatataagcaatttgcatcatataatttggagtcaaggattcgatgaatgaaactagtgggataaattttgctaagattacaaaaataatagttccgagtacattaattaagatatgaatagcacttaaacgttttgaactgcgatcgccattaagtgatgctaaaactgcggttatacaagtgccaatattttgaccataaataacattggtagccattgcaaaactaattaatcccttttgataaatagtttgcaagacgccaactgatgcagttgagctttgaatcaacgccgtaaaaactgttccaactaaaatagcggttaaaggattgtctaaatgaccaaacatattaataaaatatggggatgtttgtaatggtgccagagctacggccatactgtccattgctaaaaaaatcaatcctagggccattaagacacgtcctaaataagcaattttattttttaagaacattagtaataatccaaggacacataaatagattgctgactgacctaaatctaaagcaatcatgagtccagttacagtagttccgatattagcacctaaaataatccaagttgcttgatttaatgaaattagatgactattaaggagaccgatgagaataatagttgtagcagaggaactatgaattattgctgtgatggctgttccggtgataacacctaaatatttatttgaagatagtttatataaaatattttcaagcttatcgtttgctaaggtatcaaggctagttgacattagatgcatactataaagaaaaacaccgagactagcaataaaaccaattatatttttagtaataaaatcactcccttattattattaattatattaataaatcgataaataatgtttgttttcaagataatcattaaatgttacaatgagtgaaaggatgtgatattgatgaattatagtgcgattattttatgtgctggaaaaggaagccggagtggactggattataataaaatgttatatcgttttggtgatcaaactgtgtatcaaatgacgatgaaaacttttttaaatgatccgcgctgtaagcagcttgttgtagttacaaaagcggatgagataactgatttaaaacagttagtgacagataagagaattgtttatgtttatggaggtaaagagcgtcaagatagtgtttataatggcctgcaggtagttgaccaggatcatgtattaatccatgatggagctagaccatatataacgacagaaaaaatagatgatttattattatgtttaaaagaatatgatgcctgtttattgatggtaccagttaaagatacgatcaaactttgttgtgatgatactgttgaggtgactttgccgagggcaagattgatgcaagctcaaactccgcaagcctttaaaacgagtttaattaaagtttgttatcaacaggctcaagatagtgggtttattgctactgatgatgcctcattggttgaagagtttagtacagctccagtcaaagttgtaataggcagttatgagaatattaaaataactactcctgaggatctttaaatgaaggaaagaaataataattttattactcataaaatcattataatcattgttttattaggattgatcatgggggcgttagtttatcagttgcgcttagcaggggaaggcgaaactacgataacagctaaagagttaaagggacagatagttgatataacacatgaaacaatcagtttgcgtgatgataataatattgtttatacggtggattgtcaaaaggccaaaataaaaggtgatgagttacagtatgggaacttagtaactatcaaatatacgggtaaactcgagcaaacaaccgcgatacaagcaattgatgttttaggcttaaatgttcaagcggttcaagttagaaatggtggaactggtaatacggatgctacgatagcttcgcataagattgcagtaatggttgaaaagatgacgttagagcagaaaatagcacaattatttttagctcggtgtcctgaaagtcaagcagttgagttgttgtcacaatatcaattaggtggctatatgttatataatcgtgattttcataatcggacccgtgaggaagtaattgaaaatattcagtcatatcaaaaagcagttactatcccgatgttgattgcagtagatgaagagggcggaactgtagtacgggttagtaataatttacgcagtaacaaatttcgttctccccaagatgtttttaaagcaggcgggatggacgctattattagtgatgctacagaaaagtcggagtttttaaaagaatttggaattaatgtaaatataggtccggtagctgatgttgcaatgagtaaagatgattttatctatcaacgttcatttggaactgatcctaatgaaacagctgaatttgtgaaaaatgtcgtaaaggcaatgaatgatattaagatgggaagtgttttaaaacattttcccggatatgggaacgttgctgataatcatactgctatatgccacgattcacgtgattatgattcgcttgtcaataatgatttcttaccatttaaagctggaatatctgcaggtgcaaatagtattttgattagtcacatagtagttgatagtattgatgatcaaaatctagcatcattgtcacctagagtgagtaagattttacgagatgacttaaattatcatggcgttattattgctgatgatatttcaatggctagtgcaaaagcctttggaagtgaaggtgaagttgcgcttaaagcgattaaggcagggaatgatttaattatgacttctaatcctcaagaacatatctcggcacttattgcagcagctaagaatgatgaaatatgtctcaattcgttggatcgttctgtaatgcgaatcttaacttggaaaagtcagttagggatactgtaaaatatgatgatttaatcaaataaatcattgctttgttttgattggtgtgctattataattgagcatgtaaaaatattatatttactgcctgcttatccaaagagataagccaatagaccataggaggtatagaaatgaacaagtatgaaattatgtttattgtaaaacctgacgttgaagatgacgctagaaacgctttaatcgaaagctttaaaggaattttaactgctaacggtggaactgttgataacgttgacgaatggggattacgcgatttagcttatgaaatcaaagattacaaaaaagggtactatgtagttgttgatgctacttgtacagctgctgatgttgctgaatttgaacgattatcaaacatcaatgcatctatgttacgtcatttaactcttcgcaaatagaaggaggcgtactagatgattaatagagtagtcctagtaggacgaatgactagagatcctgaacttagaagaacaccacaaggtgatgcggttacttcttttactttagcggtaaatcgtaattttacaagcagagatggtcaacaacaagcagattttattaattgtgttgtgtggcgtaaacctgctgaaaatgttgagagatattgttctaagggaagtttagttggtgttgaaggaagaattcaaacacgtagctatgacaacactcaaggtcaaaaggtatatgttgtagaagttatttgtgatagtgtgcaattcttagaaacaagagctgctcgtgaaaggcaaccacagccacaacaacaaatgcaacaaccgtaccaacaaccacaaaataatgataatttctatgatatgaaaacagttgaattagaaaaagaatttgataattcaattaatacatatgatatcatggaagatgatattcagttttaaagaaaggagttttcaaaatggcatttagaaaacaaagaatgggtagaaaaaaagtttgctacttcactaaaaacaaaattacttacatcgattacaaagatgttgaattattaaaaagattcgtttcagctaacgggaaaattatcccaagacgtgtaactggtactagcgctaaatatcaaagaatgttagctacagctatcaaacgtgctcgtcaaatggctttattaccatacgttggtgaataataagtgttaaaaaaccttgataaaatcaaggtttttttatttcttgaggagtttctggtactaattcggtactattgtttaattcatcaagcttattaacgagatgaatttgtttatcagggtataaatgactgtaagtttttaatgttgtttcaacggtatcacctatacgttctgctatcatgagtgcactataacctaattcaataagcatggaaacatgactatgtctaaaggaatggagagtaaactcaggattaagattggctctgctttgtgcgtatttcaatcgccctcttgcttttgtgtaatgattcataaaaatatagtcatcatcctttggcttatagagattatcaatatattgcttaataatatctacaaggaattgaggaatactaacatccctatagctattgtgcgttttcggagatgtaatgacatcctttttattaatacgttgatatgattttgtaatgtgaataactcctttatctaaatctatatcttttttttgtaatgcaaacaattcaccttttctcatacctgtgtaaaaaagagtagagaatatagtgtaatcattatagtcctgtacgttctctaataaagttttcatctcgtcgatagtataaatttgcatttttttgcttttatggctaccaatgcttccggctttagtacaaggattcgtttttaggtcataatattttgtagcgtgattaaaaatggcatttagtattccatttatcttttttaaatatgcttcagaatagttttggcttataagctcattttgccatcgtcttattattatggcagtaatctcattcatttgatattgtttaaaaaaaggaagaatccttttctcgataatattgtttttaacatgtaatgtctttggtttcagtcgaggcgacatatcatcttggtaaagttttacaaagttttcaaatgacatattaagatctgtactttgttgttctagaaaatgtcgttcaaactctttagcttcacgttgtaatttgaatcctctttttttcttttgttttttctcacctttataatcagtataataaaacttacaaaaccaagttttggttttcttatcataatatgttggcattgtatttcgctccttttcatgttaaaattggagcatgaaaaatgattgctgtggtaggtaattctttttcatgctgtgcactctagttggcgctggagtgcttttttatttactgtaatatttttttaatgcgacacgatacatcgtatcaattgattgatcatcttctaaatcaaggtctaattctttgtttgtaaagagaactttgtaaataatatctttcttataatttggattatttgctttatattgattaattgtttcttcattcatgaactgagattcatatacaactttttggtattggtattgtgcatcttgtaaacttctattgatgagaagatgggcatcaagacgtaattgttcaaattgaaatttatcaactgaaacaaatgaaagcttacgaaaatcctttaataatgcatagaattcatcgaaaagtgtataaatttttatttcataatttccaaatttttcatgttccttatcaaagttttctttcatatcaaagaacttaccagaatcatataataaaatatcttttaattcatcgtgttgtacaggatagtagttatgatcaaaaagaaaatcttcgttatctaagtcaaaaaatacgcttggggaaatagagagttcatcagatatttgtttgatgacatctattttaggttcacgaccattttcataattttgataagttgtataagggatattgagccgtctggctaactcggctttagatagaccttttttcttacgttctcttgctagtatatctgaaaaagtagccatatatatgtatttaacctcctttcttgagttaattatatcaaatttgtgcaacttgtaaataaatataactcattttgaataaaaacatatgaaaattatttaaaatgagtcatttatattgacaacaacctaatatatgctattatttaattgaaaataactcaaattgagtataaaaggaggtgaaaatatgaaggttgactcaacaagaattaaaatcttattgatagaacgtcaattatcagtaaaggagttttgtaaaatcaacaacttgtcttatagtacggtctctgcaatattaagaggtcaaaggattggacaactcaaaactatcggacaaattgctgatgcgttagatgtaagtattgatagtatattaaaagaaggagaatagaaattatggaaattgaaaaaagttattatgatgtatacgatgtaattaaattattaggagttagtaaaagtaaagcttatgcagtgatgagagagatgaatgattatctagaagaacaaggatatttagtcatttctggtaaagtccctgcaagatattttaatgaaaagtggtatggtggaacacatgcctagtttaaaagaaagtgcactagcctatgctaaagaagggctacgagtctttccgctggcgccaaacagtaaaggaaagcaagttcttcattcatggataaaagaagcaaccacgaatccagatactattgaatattggtgggatacaaatccacaatataatattggcattgtaacgggcgaaaaactatttgttatagatgttgatataaaaaatcaacataatggaattgaatctttaaaacaatatggaaaagaattacctaccacaaaaatggtgaaatctccctcagggggatttcatctttactattatgatgaccaacaagaagttaaaacacgtacagaattgtatgatggtattgatatacgaggaaaaggtggctacattgtagcaccgccaagtatgatagatggtaataaatatcagtttgttaataaagaaccggttgctaaaataaatgatgcagtacgaaactttttaaatagatataaagaaaatagagagaattcatttgcaagtcaagatatcgttaatgaaggatgtaggaacgattatctatttcgtatggcgtgtttcttacaacaaaaaggatttagtgatgtggctatcaatgaatgtattaagaaagagaatgaagtaaaatgccaaccaccattagaaattaaagaaattgaacgtattattcaaagtacattaaaatataaaaaaggtatagttcaattacgaaacgaatttgagtatgaaagatcgtttactttaacacaactttatgattctaaagatgatgatgaagatgatattgttgaaaatatgatatcggtaggcctaactcttttaggtgcaccacagaaaacaggaaagacattttttggtttacagttatgcgatgctattgtagaaggtaaaaatttcttaggaaggaaagtacaaaaaggaacagcggtctatcttgcttttgaagataaaaagacaaaaatcaaaaaaagattgcaaagaatgcaagtagaccccaatgataagtttgttattgatattcttaagccgaatcatttgtatgatttagaattaagaattgaacaagagcttcaaagaaatgcagatttaaaacttgtagtggttgatacattccataagataagaaaatcaaaagatcgagactatgatagtgagtatgctgaagcgacagcttatcatgaattagcttgtaaatatcatattgcgattatcttaataacacatgtaaaaaaagaggtagatgtcaatcatccttttgattcaatctatggaagtagaggtttaacagccgggtctgattcaatccttgttatgtataagaaaaaccatttatctaagacacgacatttagcaatacaagggaaagatataccagatgatgaaatgacactattacaaaatgatagtatgattttagaaatcactgaaaatgaggatgatggtgatgttgatgagaatgttatgaaagttattaattttatcattcgaaaaaaagaatttatgggttctcatgaagatttgtcatccattctttcactttcgctgactggaagacagcttcaagctttattagcaaaaaacagtaatatcctagagtcaacatttatctcttacgagaagcaaccacgacaaaataaagcaagaccaatttgtttaagatatcatggaaatgaagaaatttagtgacagtgtgacagttgtctgacaataccttttgaccgtcacaccgtcactccttaaataagttaaatttaagattttatgtattagcaagcaacgtattttgtccccaaaatacaacatcataagctgctacgaccagcaagattggaggttcatatgaaaagaaatcatgaaattaagatacgatttaatgatgatgaattcaaaatcttaaacaataaattagaaaaaacaagcttaagtagagaagcattttctagagcttgcattttaggtaaagagataaaagtaccgcctgatctagaatattataagttaaaaaatgagttcaatcatatcggtaataatctaaatcagatagcaagagcattgaacaatagacaagacatatcactaaaaaacatcatggaaaccatcaaagaattacgacaaatgatcaagaatcttgatgaaaaagttaggggctgatcaaagcagtaacatcaatttgggctatccgagatcgtttggataacgccatcaattatgtcgaagatgaaaaaaagacaatgcaaacggtcttggattacatcagccaagataataaagtcaaacaaaaaaagtatgtaacttgtcttaattgtgatgcatttgatccattaaaatcgatgcaggtgaccaagaagttgttccatgatcataaaaggatcgtagcgtttcacggttatcagtcatttaaaatcggcgaggtcgatgcaaatgttgcacatgaaattggagtaaagttagcacaaaaagtgtttgggaatcgcttcgaagttgtcattaccacacatctagataaagaacatatccataatcatatcttgttaaattcaacttcattcattgatggaaaacgattctgtaataccaaaaaagattactggaacatgagaaatacatccgatgaactatgcaaagaatatggtttatctgtcatcgaagatccatcctacgattcaaaaaagttgaattatcatatcatgaaaacctatatgaatgacattaaaaaagatatcgatactttggtaaaagaaagcaattgtattagggatttaaaggataatatgaaaaagaaagggtatgagttcgatagaattgatgaagaagatgttgtttttcatccgtattgtaatgaaccaatctatctaaaatcattaggagaaaggtatcatcttgatgaaattgaagaaagattgactgacaaatggattcttcctcaaaacgttgaacatacacaaagctattatcaatgtaaggaatattatcaactttataaaagaaaacagttacctaagctagcaggaatacatgttgcttatcttatttcaattaatatcttacctacaagaaagcgacatatatccaaagaagcaagacaagcactcaagaaaatggatcaatattctagagaaattgaacttcttgccaagaacaagatagaagatatcaatcaattaaataactaccaacaacaaaaacaagatgaactcaatgacctattaaaacaaagacaagggtgttattatcaacgacaacgagcaaaaacgatggatgaaaaagaagaatggtcagcaagagccaagttatttacaccagaaatcaagaagctaaggcttcaaatcaaagcgtgtgagaacatcaggaatcgtagctttgataaagatattgaaagaatagcacagaagaaaattaaacaaagagatgcaagataggatggaaatgacaatgaaaaagatcaaatataacaaagtaggagattatgagtttccatcattaaaacaagaaagaccaataccaaatttatcaagattaggaacagaatatctaagaattttaaaagaaaaacatccagggcattaccttgctttaccagtaagagacgaactgaatgaagaattgattcgttttgataaagagttaaatcaacaatatgaaacctttgttgaacaatacaaaatatcaagaaatataacagaagaattaaagaaacaagatcaaatgaagtgggtgaaggaaatgaatgatatcaaatattttgctaagaatatgttaatagataaatataagtatttgattttgatctgatgatttatagtataaatataggaaaaagacctttttttcaaaaaaatcaagtgtaacatacttacacttgattttttttgaaaaatatgtgataatgattttgtcaaatgaaaaagctctatatcccaaggctgagtaaggacatagagcttagcatcttgcgatactataacacacattcattttattaaaagatgctgcatttgtcaatataaaatgaaaggaggaccttggtttatggtctatattgatgcagtacattatgaaaaaaatatatatggttttgaagtgatttcacacttgaaatggacaaatactttgtcgcaacctgccacaaacatttgtactaaaagtgagttgattgattttattaaaaaaaatcctaacagtacaaaaactaaatattataattcatggaaaggctgggttgttggcgaagatgtgagagtagtagataatagctatttgagaactgattccaataatattaaggctgataatttgggctctctccctagattttaaaaaagtagaccaatgaagctcagcatcgattggtcttttttttgcgaaggtggtttgatgaaaaagaaattaaaagatgtggctaaaataaaattttgtttatcacaaaaagtgatttcagacgaaaaacataaaataataacgccaattaatttattggagaataatgtcatagataattttgtttttgatgatagggttcgagttaataaagatacaaaagtacataaaggagatattcttataaaaagagtaagtccttcatttgtaaattatattgatgagattgatgaggatacgtatgcttctggaaatttgataataatttcggcagtatctgttgaatctaaatatcttgcttatattcttaacaaagaaatttcaaagattactcaatctctatctggagcaaaaatcccgtctattggaagaaatgatttagaagagatagaggttccaatcctttctataaaaaggcaaaaagcaattggcgatttgtggcataaaagtattgaagtttataaattaaaaacaaggttaaatgagttagagtttattaaagtaaaagggattttaagtgaattggtgaatggaggagagcaaaatgtcaactaaaaaaacaacttttgaagatatcaaaaatgctttgtgggcaggtgcaaatacatttagagataatattgatgcttctaattataaagattatgtcttgtctatgttgtttgtaaaatatttaagtgatacttttgaagaaagtgtagaaaatctaaagaaagaatatgaagggcttcgactagaaagacaaatttctaatcttccttttgtccttaaagaggagtatacatttaattatttgttaaaaaataaattttctgtagacataggatctaaaattagtgaagctttaactggaattgagagcacaaatgcgattttgtctggaatttttagaggcattgatcttaatagcgaagctaatttgggcaagaaagagcaaaagaatccacttttaaggacgttacttgaagattttgctgatttagatttaagacctagccatattgaaacgaaagataatgaagttccagccgatgttgtgggagatgcttatgaatatatgattggcgaatttgcaactatggctgggaaaaaagcaggaagtttctttacaccacagcaagtatcagaggttatggcacaaattgtatctccacaggaaaaagaccgtatatatgatccaacttgtggatctggctctttgcttattagagctgcgaaaaaaggaggactagacaaagtttcaatatatggtcaagaggtaaataattctgctatttctatggcaagaatgaatatgtttattcatgatataaaagatgcacatatagcttggggtgatactcttgcaaatcctcaacacctagatagcgacggaaatcttatgaaatttgattgtattgttgctaatatgccttttagcaagaacaaatgggcagagggttttaatcctggtggtgaggtttcgattgacgaagatgaatctaatactaaatcaactaaaaagggtaagaaaaaagagtttaagatggaaccatctcttgacaggcatcatcgatttgatttaggtgtaccgccggcaagtaagggtgactgggcatttttgctccatatgatagcgagtatgagcggaaacggaagaattgcagccgttgctcctcacggagttttgttcagaggtgcgtctgaaggacgaattcgtcaagcggtaattgagaaaaatctcattgatgctgttatcggattgccggaaaatttgttttacggtacttcaattccggcctgcattgttgtatttaaaaaagggcgtaccacaaccaatgttctttttgttgatgcttctaaagattttaaaaaagaaaaagcaaaaaataaattgcgtgatggttcaaatggagaaccgaatgacatcaagaaaatagttgatacttacaaagcgtttataaacagagaagaaacagcagagcaagaaaaatacagtcatgttgcaactctcaacgaaattcaagaaaatgagtacaatctcaacattcctcgctatgttgatacttttgaggaagaggaacttatagatttggagagtgtaaacaaggaaattacagacattaaaactcagatttcttcacttgaaaaagagatggaacaatgtatgaaggagcttggtttatgagtgatattgtaaagtacagcgaaacatattaagcatataaacaagtacggagaagagttttggtatgccagagaattacagctggtacttgaatatgtacaatggcgaagattttagaccatatgggcagtacggagcttgcagctaatctgttccgtgccacgcagacggaagaaaaattgcgccgtgaaagcattcaagggaaggagaatgccaacaaaacgcactatgaggtcggtgtaaaagtgcgtaaaactatcaaggaactcggtgatactatgccggaagatttgccaactactgataaaagtatcaatcagatagaacgggaaatggaaaagaaaaaactgaagtaggtaaattgtatgattaaatttaatgaaatagatttatcgggggttaatgctgccctagcaaatagtgctcgtcaggcagcagaggtatctgttgttatgactgacagagcggattataacagaagaaaagacgaagcactttttgaaactgctgagacaagccgagcacaaaaagaattacttgagcagcagctaaaagaagtgagaaagcagaattgtcttttgaaagagaataatacagcattaaaggaaaactattttactctcaaagagttatatgaaatgacaaaagctgaagcgaaaagtaatgcaaaagaagcaaatcaaaataaaattttcggctgggtgtcatttgtggtaggtaccgtcattgggattgtgggtatcgtaattggaattatcgtttaggaggtcggcatatgaccgaagaaataaaacaaagaatagaaactataaaagcaggaaaagtgcctgacggctacaaaagaactgttgtaggcattgttccaaatgaatgggaaaataaaagactgtctgaattgctaaagtttcagaatggagttaatgctgataaagaaaagtataacagcggaattaaaatgattagtgttatggatattttgtctaacagacctatattttacgacgatattagaggacaagtggacatagatgaaaaggctttgaacaactatagcgttacctatggagatattctttttcagagaagttctgaaacgatagaggatgcaggaaaatcgaatgtatatctggatgaaaagaacacagctacatacagtggatttgtaatcagagggaaaaagatagctgattatgatcccttttatttaaatgagattctcaaaacatccggtattcgacagcagattataaagtattctgcaggatctcagcacattaatgtaagccaagattcactttcaagggtgaatgtatgtcttgcaaacgaatatgagcaaaaccgcatcgcagaaatcctgtctaaatgggacaaagcaattgagttgcaggaaaaactgattgaaaagttagaattacagaaaaaggctttgatgcaaaggcttcttacaccgaaggcagggtggaagaaagttaaattggggaaattagcttttatgcaaagtgggggcacaccaaaaagtacagttgaagaatattataatgggaatattatttgggtttcgataaacgatataagttcttgtgggaagtatttatctgatagtgaaagaaaaataactgaaaaaggattaaaaaattcatctgcacgattatttccaaagggaacgattctttatgctatgtacgcctctattggaaaatgttgtattgctacatcagagtgcagtacaagtcaagccattttagggataatgacaaatgaaaaacttgtttctgaatatttgtattactttttgatccatcatcaagaacggatactggcacagggacaaaaaggaacacaatcaaacttaaataaagaaatggtacagaatataaaagtagacttgccagatacgatagataagcaaattagtatagttaaaattttgaattgttttgatcgctatatggatagtcatatagaaaaattagctactttaaaacagcaacaaaaatcaatacaacagttgctgttaactggaattgtaagagtataaggaggaaatagaatggctaaaaacaaaccttatggtgataatgctcgtgtgggagcagtaaaaaacagaacgcaggtatataaccctaaaaccggattatggacaaaaagagacagtgaaacagggaggtttatggaagtaaaaacatcttccgataaaccttttaagggtataacaaaagaaaaataagttcagtaaaagcctgctttttaagtctggctgttgctgcttatgtgggaggaatagagatatgccaaagcatacaatatttaatgagcgtccggaatgtcaggacaggcttatacatcttttaattaatatgggatatgaatatgtctcacgcagtgaagcagaaagcaaaaggagaaacttgtcttccgtactgtttgaagatgagttgattcactttttaagaaaacaaacttatctatactgtgggcacgaattgcttttctcgggagaatcaattacaaaagcggtaaaggaattggatgcttcccttttgcaaggtctttctatggcaagcaaagaaatatataatctcattactttgggaatcagtttggaggaaagaattgcaatagatagtgatattccagtaaagcagtcgtttgacttgcattatattgattttgagcatcctgcaaataatatttggcaggtaacagaagaattcagcgttcagcgtccaaacggaagttatgcacgaccagatgttgttttaatggtcaacggtattccttttgttgtaattgaatgcaaaaagtccagcatcgatgttatggaaggcattcatcaaaatgtccgcaatatgatgcctgactatattcctcagctatttaaattttctcaacttgtaattgcaatgaatccgcagaaagttctttacggtacaggtgggacaacctctgactattttgtagagtggagagaagatgaagtcaaatggcaggatgaaatttgcagaaaatgttcgccggatggttctattttggagcaggataaatttgcagtttctttgctcagtaaagtaagactacttgatctggttcagaattttatactttttgataataacatcaaaaagattgcaagacatcagcaatactttgcaattaataaatctatggacagaattaatggtaaagatggaagttcttcaaaaggcggcgttatttggcatacacagggaagtggaaaatctctgacaatggttatgctagttaaaaaaattcaggcagtaaaaggatatgaaaatcccaggtttatcattgttacagaccgtataaaccttgataaacaaatccgtgataattttgctaattctcaaatggcacctgttcgtgctgcgaccggaaaaggacttaattctttgttgaagaataaagataacatcgttatcacaacactaataaacaagtttgaaacagtgtacaaaaacagatatttagagcctgacagcgataaattctatgtattggtagatgaggcgcatcgttcgcagtataaatcgatgtttaattatatgaaagaagttttgccaaatgcaacgctgattgcgtttaccggcacaccgcttattgcaaaagcaaaaaagaatacttacaaaacttttggagagccgattcataactatacaatgaagcgagcgatagaagatggtattacggttccgctcgtttatgaagggcgtaaagtcaaacaggaagaacctgcattgacgatcaacaactattttgaaagtttgactgaaggtcttccgcaagaacttaaggataaactttcagacaagtttagtagatttaaagctatatcagaagccagaagccgtatcaatttaataggatttgatattgcagatcattttaaaaattattgtgttccaaaaggcttaaaggcgatggttgtgtgttcttcacgagcagcagcggttgaaatgtatgaagtgctaaaaggtatgtctggaattaaccctcgtgtagtaatcacatttggagataagagagagggtgatgatgacgaaaccacagatgaaactataaaaaaaataagggcatattatcagaaaatggtaaagcctttatttggcgacaatgacgagaaatatgatgatcatgtttgtgaagattttaaaaacccggaaggcgaaatcaatatgctcattgtcaaagataagctgttgaccggatttgatgcccctgttgccggtgttttgtacttagataaatctattcaacaacattccctattacaggctattgcaagagtgaatcgagtttataaagggaaagatttcggcttgattgtagattattggggagtttttaaaaagttaaataaagcaatagatatgtatgaagacgctgagtccggaatgaatggatttgataaagccgatattgaaggcgctatctttggtccgattgatgaaaaaaataaactggcagcagcgtatgaaaatctaattactatgtttgaatcgattaaagattcccaatcttctgatgtttggcaaaaaagtcttgctgatgaaaaaacaagaaaagagttttataacaaactaaaagaatttgctaatttactcaatttggcattatctaatcgggatatatttgtagaggtaggttttgaattaattgaaaaataccgcaaggaatatttattctatagaaaattaaaagatagtgttatgctacgatatgatgatgaagttgatttgtctaagtatgaacaagggataaaaaacctaattgatacttttgtgaatgcaacagatattgtatctgtagttaagccagtttctatcggtgatgaaaaagcgatgaaaaggcttcttgagaatatggattcaaatgaatctcgagctgatgcgataaaaactagaatggaatctaaactcaaacagataagatatgatgatcccttgctgttcgaggaattttcttctaaaattaaaaaaactattgatttatacaatgaaacacgcgacgcagatgcgtatttagaaagtatgaagataatggctgatgattttagaaacggaataacctcacaagattatccttctcaaattgcaaacgacagtgattcaaaagcattttatggtgctattattactcaactcaaaaaaaatgaaacaataaaagttataactgataaagaggaattgattgcaaaatattcgtgccgaattaaaaaagttatcagcgataatgcaaagcgagactggaaacacaacgaggttgtacataaagcgatgcacagaaatttagatgattgtttatttgatatgtttgaagatatgggcattgtcattgataaatcaaatattgatttgctcgacttaattattgatgaaataatgaaagttgcggtggcgagatactgatgaataagtatattctaaaattaacatccccttttgataaaaccattgtctgtatccatcataagaatatcaaaaacattcatcttaaagtttttagggatttgaaagttgttttgtctgtgccaaatggagtaacagacgagtggattactgagtttcttattagtaaatcaagttggatagaaaagcaactacaaaaatacaaacaatcgagcggatataataacttaattgatatcaaaagtggaacatctactcaattgttaggaaaagattgtagaatcattaagaaaatctctgaaaaaaattatgtgcttgaggatgagaaaaatattattgtttatgcaaataaaatgagcaataaacatcaacaagtattagaatattggtggcgtgaaaaagcatataagacttatcagaatgagatgaacgaactctataataagatttttaaaaagtatggaatagaagaaccgtctttatatgtcagaaagatgaagactttatggggaagctgtacaccgtcaaaaaataaaattacaataaatgagtatttgttaaaagctaatattcgttgtatacaatatgttatcttgcatgaattaacacatcttatttatccgtatcataataatgaattctatacttttctgactattcatatgcctgattggagtgaaagaaagaaacaattagattttgaggttgtacaaggaatatgataaaaatagaacatatatgtattaatgataaaaataattttaaatacacaaaaaatgagtttaatgtaaattttgtcaaatggatatggtaggtgtaagaattcattttgttaatatttgatctattcttagaatatagaaagtatcttgagatgctttaaattagaaattatacttgccaattagtttctaatgttctagaaagtatgaggaatcaagatattaaaaatgatatacctattttgtaaaaatatattacagtaaggaatcgtaggaggaaaatttatgaaaggctctgaagctaaaatgacaggctttatggaaggcgctgacaaacgttatgtgattccagtataccagagaaagtatgattggaaatatgaaaactgtcatcaattatatgaagatttaaaaaaaatagcaattgatggtagagatagtcatttttttggcagtatcgtttctgctatcgttcctaatggcagtaaaatagaatatcatatcatagatggtcaacaaagattaacaaccataacgttattacttttagcaattcgtaatcttatagcaaaaggtaaagtaagaacaattgaaagtaaacttgatgaacagattaatcaacgttttcttatttcaccatgggctagtgaagatgataaaattaaacttcgcccagttaagagtgatagagatgcacttgcaaaactgtttggagatgaagaggattatgatcatagttctaatcttacaatcaattatcaatttttctacgacaaggtgatgaaagaggaaattcctgtatcagatttatatgctgcaattggtaaattagaaattattagcattacattagaccaaggtgataatgcacagctcatctttgaaagtttaaattccactgggttggcactgactgaaggtgataaaatcagaaactacgtattaatgggtcttcctactaaggaacagacgcagtattacgatacatattgggcaaaaatagaaaaatgtactaataacgatgtcagtggttttataagggattatttaagcataaaacagcaagtcactccaactattagtaatgtatacagggcttttaaagagtatacaaaattcatatcacttcctatagatactttacttacagatcttttacgatatgcaagattttttgaaaagttacttacttgtaaaagtggattagaagaacaaaaattggatgattgtctgtatcgtttaaaacgattggagattgttgttacccgtccatttttgatggaagttttaagattatgtcaagatgaaaaattaactaccaatgatgttttaagaatatttttaattgttgaaaattacttatttagaagaaatatctgcgaagtacctacaaatgcattgaataagattttcttgaatttaaataaagaaattattcgctatgataatactatggatgattatgtttcaaaatttatctacgcattactttcaaaaaaagaaagtggtcgattcccaaataatgatgagtttagaacagctttagaagaaaaacaagtatatcagatgcgtggtaagtataaggcttatttatttgagagatttgaaaactatggaacaattgaaactaaggatgtttatacacatcttgataataatatttataccatagagcatattatgccacagcatttaacaccagcttggactgaaagcttaggagtgaatgctgcagaaattcatgctacatgggtgcatcgattagcaaatcttactttaaccggatataatcctaatttgagtaataatacttttgttgaaaagcgtgatgctaaagaaggtggttataaagcaagtgggttgaagatgaatcagaaaatttctacaaaacagaaatggggattagcagagcttagagaacgcaatgatgaaatgttagatatggcaatggaaatctgggcatatccaacaacagattttatgccatcagagaaagaatttgactcatgtactttggatgatgaaaattttgatcttactggcagagatattgccaagtacagttatttaaatacagaacagccagtaacaagttggactgatatgtttgaacatattgttaagtatctacatcataaagataagtctgtacttattacacttgcatatagtaagaaagaaaaaactgacctcgctacttatgtttcaaataatgaatctaatttacgtagtgcactcaaaatagatgaaaatctatatattgaaaaaaatacaagtacaatacttaagatgtctattctaagaagaatttttacattgtataaagctgatccgatggatttagttttctatttgaagaatttagaaatgaaaagagtttctgatacaagtagatttgaaatcagaagaagatattgggaatatgcacttccaattattcaagaaaaaaatatgcataggggtacatttagtggatgtaatccaactactacaaatactgagtctggtttttttggtataagaggaatctgtataagctgtattgcaaattatgacaaagcacgaattgatttttatttaggtaatggggataaaaagaaaaataaaaatattttcaatatgctgtataaacataaaaatgaaattgagagcaatttgggaatatcactagattggaacagagcagacgattataaggcttcctggataagttattatcttgataatgtaagtattgcaaacgagaatgactggccaaaaacagctaaatttcatgctgaatggagtgagaagatttcttcggtaatgcttgaatatttgcttaccgacgaagagaaacgattgaataatattgtagctattttcagagcatgggcacaatcaaaatcagaagtttatcttgatgtttctaaatgtaatagaacttatacccgttttactacaaatagaatgacttcgattttaccagatattcctggagcattaagtggatggaatactgataaccactatttctatgaaatagtgaatagaaatggaaaacaatcatatattcagttagtgattagttcaaaaaatattactgatgattttagaaatatatgtgacaatatcaataaatactatccggctaaattgaaaaaaagtaattggcaatggcgaacaccatttaagactaaagcattcgaacttggagaagaattgaatgagatggatattttttctaaactgaattcttgcatgaatgagatacttgcatttgaattggatttgataaatcgtcttagtcaaaaatagttttgaattatgaagcttgtttagttaagataagttttttcttaagtctacttaaagaagatagaagattatagtaaaaaaatttaacattctatgtataactagaaaatccattcgtaagaatttattaaagatataagtgaggacataaaatatgagtttagtaactatgaataataaagtttactatggggagtattctttaaagcattggataaatttaatattaaaaggtaacattaagttaccagaatatcaaagatactttgtttggaatctcgaaaaaacgaatgatttaattttagcattaaaagaaaaacaatttatccccccctgttacaataggtcattttaaaaatgatcttgaaagtattaatttgattttagatgggcaacagcgtctgacaagtatattgttagcttatttaggaattttcccaaataaaaaaaggtttgaaaaaacaaaagaaaaaggatttatcgatgaaaatgatgatccaattgatgatgaattgattgataacattttagaatggaattttaatatactaatagaaaaaggagtaacaaaaaatcaaattaaaggaaatatttattcggattattatattgatgttgattttgaagtagatgacaatttttttgataataacttcttaggattttcgtacttggttccaaataatgaagatgaaaaagcacaacaaaagtattattcaaaagtatttaggaacataaacatacaaggtgaatcattattaccacaagaaagcagattggcattgtattatttagataatgatctagttaattattttaatccggaattttgtaacaaaattttagttaatgattctaaggtggattttgttagatatttggctttgttatctcaatataaagacgcgcagtcaattaattctttagcaaaaggtttttcaagaaaaatggaaaaatactatgaggaatttatatattttgctgttggtgaagaaacatctaaaatttttggtgatagttctttaatttttaaaaagaaaaatatttcagaaaattttgatcttttggaaaaaacaatcgctcaattagatctatttaaaaagtatgaatcaattatagatttagatatagcattatttggattaatatattttattgtatttatggaaaaagaaattgattgttgtaataaaaatgaattgcttaaaaagataagtgaaaaaatagatgaattaagggggattccccgtcatcttaaaactccaagtgcccttaagtatctaagaaagagggtagaagattcaatttcaatatatgaggaatttgtaaaatgagtaagcatgataaatttatattaactccaatgtcaacaattttagaagaagctatacaggctagctcaggaataggaagtgggatagaaacttatccattatgtgattatattatgcaatcaatatttttaaaaatgacaggatatcaagaacaaaaaatgaaatgtatagcttgggaaatagctacaaataattttgagtatagaagaagacttttgaataatgatgataaattaggtgaatgttctacatatgattcaaaaaataagatatataaagccttatttaaacaaataaaaagtatagattcaaattatgaaattgaacagagtattaaagtaaggataaaaaataattcatttaataaagtgaaagatatgtttatggatacaaatttagttacttggaataaaaagttgtttaatgattttctagaaagcaaattaataaaagaaacgcaatatttaaataattcaagaaaagtatgacgaaatatataaacaacgaaataggcttgcacataacactcaatcatatcaacagaatctaccagattttaaaatgttaagtattgaaaaagagtattcaagaaattattttttatggtttgccatattgttattaatagataatattttcatagaactatacaaaatatatatagacttatttgaaaattgcatagtataaataatataccaaatgataataattcaattatatagaaaaatatgtaaccactacacgagaggctcaaagtaacgtatataatattaatctttaaattatattttttgctaagaatattaacaaatttgttcactataattgttttgttttagagtttgaatagtattaacaattttaaattggtatcgttatgatgctttttgttgtgatttgtacagtattaattaatggtactattttggtactaagatacactgtaaataaaaatagtcaaaagatacaatggtaaaattaagctaaatactgacttaaaagcacttattaaaactaaaatattttaaagtttatcatacgttggtgaataattgaaatttaaacccttgatgaattcaagggtttttctttttttctaaaagatttgacatcaaaaaatcttttaaatagaaataataggtgtaaatatagtgatttatggatgagaaaccattaaaaatcaataaaataagtgttatcatacgttggtgaataattttgactaataaaccttgattaaatcaaggtttatttatagaacagtttgatttagcaaatcttagatattgtttaaagttatagttaacaaatcatataattttataaaaagtaattatataatgaaaaagattatctttttaaaataattgaataaaaatggcatttaagtataatgaaaagaagaggtgagtatgatgattgcaagtgagaggtttttaagaatagtaaatacagttaatgaacgtgggtttatttcaacaaaagaactttctgaaaacttagatgtaacagaaacaacgataagaagagattgtgaagaacttgaaaaacaaggactgctgataagggttcatggcggagcaaaaagtattgagcaaaaaacaattctttcaaataaagatgaaaaacaaatgagcgaaagaattactaataataaagagaaagatttagtatgtaaaaaagcagcatcatttatcagggatggagattgtatatttttagatggtggaacaagtattgtaccgatgctaaaatatataaaaggaaaaaatgttaaaatagtaacacatagtaccttgattgcaaatggatttaatgattttgaatctgaattatttatgattggtggtaaatatattccagaatacaatatgtcagttggtccaattactttaagtgacttagaaaagtttaattttgattatgctttcttaagttgtgccgggatagatatagatagaaaattagtctatacagctgaaatggatacaatggcagtaaaacaaaaagcaatggacttagcagtaaagaagtatttattaattgattcatcaaagttaagtgttaaaggtttttgtagctttattagcagtgatgattttgatgcagttatctgtaataaggatgctcatatgaatattgatgatatcccagtaaattatattttaacaaatgaagattaaataaagacatattgaactagtttgtttgatatgtttttttatacaaaaaaacaaaaacgaacaaaaataaacaaatatatgtttacaaatgtttgtttatgtgttattttttaattaaggaggaaagataacgaacaaaaacgaacaaaaataaatagttatctattagaaaaatgaaaaaaataacaaaaaaggcaaatgaaatgaatttaaaggagttagcatcttatattgactattcagttttaaaaccagaatttactgaacaagaaattatcgatctaacaaaagatggagtaaagttaaattgtgcaactatttgcattaatcctggttatatggatttatgtgagccttatgttaaaggaacagacacaatgctatgtccagtatgtgattttccatttggaacaagctcaacagaatctaaagttaaacaaattgaaattgtggctaaatacgattcggttaaagaaattgatatagtcgctaactttggaatgatcaaaagtggaaagtgggaagaagttttagcggatattaaagcctgtaccgaagcggcccataaatatggaagagaaattaaagttatttttgagactgatgctttaaatgagttacaaataagaaaaatgtgtcatatttgtatagaagcgggtgctgattttgttaaaacaagtactggatttttaacgggacatgaagctcatggagcgagtttggaaataatcaaagtaatgatggaagaatgtggtgataaaattaagattaaaggaagtggatgtattcgaacaagagaacattttttacaattgattgatatgggaattgatcgtatgggagttggatatagatcagtatctgttgtgttagggttagactagctaatcaaaagtgtttacaaaagctaagaagagaaggggcggtgtaaacgatgttaaataaaatggctaatgaagctagaaaaagtattattaaaatgatatatgaagctaaatctggacatccaggtggatctttatcttgtattgatattttaatgtacttgtaccaaaaggaattaaagctaactaaagataatattaattctaatgaaagaaataagctggtactatctaaaggtcatggggcaccagctttatatgctgtattaaaagaaatgaaagtgttagatgaaaaagagttaatgacttttagaaaaattaattcttctttacaggggcatccaaatatgaatgatacgaaaggtgtagatatgtcaacgggatcattagggcaggggataagtgcagctgttggaatcactttggcaaataagtacaaaaataataattattatacttatgtaatttgtggtgatggagaatttgaggagggacaagtatatgaggctctaatggcagcaagtcattatcaacttagtcattttattctttttcttgactataatggattacaaattgatggaaaaatagtcgatgttattgggccacaacctttcttggaaaagttcttagcttttggttttgaagttatcaatataaatggtcatgattttgatgaaattgaagcagctgtggagatggcaaaaaatagtcaaaaacctactgcaatcattgctcatacagtaaaaggaaaaggaatttcatttatggaaaatgagattgaatggcatggaaaggctccaaatcgtaaagaaatggaacaagctctgagggagttaggaggtcattaggatgaagattgcaacaagagaggcctttggagaagcactaaaagagctagtgataaaaaataacgatgttattgttttggatgcggatttatcgcccgcaacaaaaacatgttatgctaaggaagcaagaccacagcaattttatagcacaggaattgctgaagcaaatatggtcggaataggtgcaggtttggcggttcaggggttaaagccttttgtaagttcatttgccatgtttttagcagggcgtgcttttgaacaaattagaaattctattgcttacccacatttaaatgtaaaactttgtgcaactcatgccggcttgactgttggcgaagatggagcaactcatcaatgtaatgaagatattgctttaatgcgagttttgccgggcatggtagttttgcaaccgtgtgacgcaaatgaaacaaaagctatgatgcagtttatggttgactatgatggtcctgtatatttaagaacgagcagatatgcagtggataatattttggactctaattataaatttcttttaggcgaaatcgttccaattgttaaaggttgtaaaattgcttttttagcgactggtattatggtaaatgaggctaggaaagctattgaaattttagctaaaaataatatatacccgtcattatacaatgtgtcctcacttaaaccaataaatacgatgcaactaaattcaattataaatagttatgatcttatctttacattggaagaacacaatattataggtggtttgtatagtttagtttgtgagaagttggataagcctaaaaagatatatccaattgctatccaagatacatttggtgaaagtggaacaccagaggaattaatgagtaaatataagattgatgcagattacctagtaaagtctgtattagaaacagtggaggaataaaaatgacaaagtttaaagatgattttttatggggtggcagtttagcagctaatcaatgcgaaggtgcttttgatgcagatggaagaggtctagatttaatggatgtaattccgggcggattagaagcaaggcaggcagcatatgcttcaccacttgattatatgaatgaaaatattgagtattgtccaaatagaattgcaatcgatttttaccatcgttacaaagaggatattgctttgtttggagagatgggtttcaaatgtttacgtttgtcagttaactggacgcgtttatttccgtatggagatgaagaacaaccaaatgaaaaaggcctaacatactatgatagtttaatagatgaattacttaaacatggaattcaacctttaataacacttaatcattttaatgtaccgttgtatttagcaaagcattatggtggctgggctaatcgaaaaatgatcgatttctactgccgactagtccgtctgttaatgacccgttataaaggaaaggtaacaaaatggttaactttttgtgaaattaatgttggtttatttcagccctattcaaccctaggtttattatatagaaaaggtgataatattgaacaaattaagtatcaggcaatgcatcatcagttactcgcttcagcattagcaacaaaaataggacatgagattgataaaaataatcaagttggatgtatgattgcaggtggggtcgtctatccgtatacttgtcacccatcagatgtattaaaagcttttgaggaaaataataaggaactaatgttgacagatgttcaagtttttggagaatatccatatcatatgaaagctaaaatgaaaaaagaaggaatcactatacatatggaaaaagatgatgaggagattctaaaaaataatacagttgactttgttgctttcagttattatgcaagtaaagtagtaacgacagatcacagattaaagatcaataactatggcaagttacaaaatccttattgtgatgcatcacaatggggatggatcattgatcctcaaggaataagaattacattgaatttcttacaagaaagatttcataaaccattatttattgttgaaaatggtttaggagcacctgatgttgtagaaacagatggctcaattaaagatgattatagaatagaatatttaaaagcacatattgaacaagtaaaactagcactagatgatggaattgatttgatgggttacttaacctggggcccaatagatgtaatttcagcaactgaaggtcaaatgacaaaacgttatgggtttatatatgttgatcgagatgatgaaggaaagggaacattaaaaagatcaaagaaaaaatcatttaactggtataaaaaagttattcaatcaaatggtgaggaattagaaaatatttaaagcagataaggggatgaagatcatgtcgagaaaatgtataatcggacaatctggtgggccgacagtagttattaatgcaacattagccggggtcattcaaggagctttgaaagcagattatgagaaaatatatggaatgattaatggaatagatggattgttagatgaaaagatggttgatttaagtagttttaaagatcagaagaatttgtttaagttgattcatacaccagcaatgtatttaggctcatgtagatataagattttcgaaaaggatcaatcaattaagcaaagaataattacaatattaaataagtatgaaattaccgacttcttttatattggtggtaatgattcaatggatactattgaaaaattaagtacttatgcaaaaatatgtaattgcccaatcaactttattggtattcctaaaacaattgacaatgatcttatgaatattgattatacaccaggatacccttctgcctgtcattatgttgctacctcattatgtgaaattgcttttgacagtgttatatatccaataaaatcagtaacgatcgtagaaattatggggcgagatgctggctggttaacagcttcagcacaacttgttaatgaagtctatcctgattctatcgatttaatttatatgccggaaaacatttttgatgaaaatgactttcttgaacagatcaaagataaattaaaaaagaaggatcactgtattattgctgtatctgaaggtattcgagatcaatatggaatgtgtgtatcactagatagtgggattcaaaaagatgcatttggtcatttatcaaataatggctgttcaaattatctaaaaaaacttatcggtgaccatcttggctgtaaagtacgggccattcagttaagtacccttcagcgttgtgcagcacatttagccagttacatagacatagaaaatgctttacgtattggtagttatgcaataaattgtgcgttggataaacgaacggggattatggtcacaatttcaaaaaatagaaatgaatttttattaagtcacgttgatattcataaagtagcaaatcatgttaaaccatttccattagaatggattgatgaaaagaataagaagattaaaaaagaatatattgattatgtggttcctttaatatataaaagtggacaaattgagcttcctcaatatttgcaattaaatgaaagatagtcaggcttttaatcttcttaatcaatttttagcgataaatacatatgatgaaaagaaaaagtatgatctgattttagtattaggaaatgctattgctgaaactggattaatagcttatcaactatacaaaacagggcatgcttatcacttcatgattgctggaggaaaaggtcatactacagatattttaatcaatacgattaaagagaagtatgatattaaagatattactaaaagaagtgaagcagaattatttaagtatcttattgaagaaaattatggggtagacaatactattttattagaaaaagaatctactaattgtggggaaaatattcagtttgctttcaaacttctcaaaaaagaagacattatagtaaaaaatattttattggttcatgatcctcttatgcaaaggcgaatcgatgcaactgcaagacattatgctccacatataaattttgataattatagatgttttttgccagttgttgagaatattggatttgaacttaaaaataatatttggggcttatggtcaaaagaacgatatatttcacttttattaggagaaatgaagagagtcatcgatgataaagatggctatggaccaaatggtaagcagtatattgaacatgttgaagttcctcaaaagatactggcggcatatagatatatcttttttcgatatggtaaatatcaaaggaaataaaaactttatcaataatatttagacttttggtgaaacaaaagtcttttttatgatttcttaattttggaaatgaattgataaacggtgtaaacaatattattgtgtaaatataaattaaaaggaggaaagaagatatgaaaaaggcagcagttattgtagctccagggtttgaagaaggggagacgttatctattatagatattattcgtcgtgctaattttcaatgcgatatgatcggttttgaaaaggatgttgcaggagcacatgatattattgtgaaatgtgacagcgtactaaatgatgaggtaattgattatgatatgattattttaccaggagggtatcccggtgctgctaacttaagagataatacaaggttaattgaaattttaaatataatggcacaaaaaaacaagtatatttgtgccatatgtgcagctccgattgttttagaaaaggcgggattactaaaaggaaaaaactatactgcttatgtgggatacgagcaaaaaataaaacaaggaaattacttacatgataaagtggtgattgatgggaaaattgtaacgagtcgcggtccagcaacagtttatgcatttgcatataagctggtagatttattgggtggcaattcactagctctcaaaaaaagaatggtctattttaatgcttttgatgttaaggaggatgaatagtatgagaaaagctgcagtattggtagtagatggatacgaagaaagtgaaacagtgacgattgtagacttgttaagaagagccggaattgagtgtcatacatttggttttgctgaacagtacgttagggggatgcaggggatgatgataaaagtagataagatttttagtgatgagatcaaaaattatgatatgctggttttacctggcggaagaccagggggtgtgaatttaggagcaaatccactggttattgaaatggttcaatactataatgaaaatggaaagtatttagcagcaatatgttctggaacaattgttttatcaaaggcaagagttatcgacggtaaaaatgtgactggctatactggatatgccgataaattagtaggtggagaatttgttgataaggttgttgtttttgatcagaatattataacaagccaagggccagcaacatcatatccatttgcatttaagattatcgaagtgttaggtcaagatgttagtgaaatgaaggaaagactattatataactttgctggtggaagataagtgaaagtgagtgataataatgatctatgataaattaccaatagtttttttaagtacgcttgtcagcgaaaaaaatggttcaactaatagccagatagcagcatatattttgaatcaccttgaggaagttcaaaatcttggaatcaaggaaattgctaaggaatgcaatgttgcggtaagctcaatttcccgtttttgtaaagaagtaggtttaagggactttgctgaattaaaagaactgttgttgtcaacagatttatcttttgaagatcattcacacgcaacttcgaaacaagcaagactgcatgattatagtcataaagtaagagaaagtattatcatggttgaaaaatcaattgatatggatgcagtaattgatttatgtaaggatatcaatgaatatcaaaaggtagccatttttggtttgttaaaagctggagcagtagcttttaatttgcaaggtgacttattaatgctgaataaacaggtatatactaatatctcctattctcaacaaattcaatatattgttgcggctgatgaagatgatttgattataattttttcgtatacaggtgcatattttgattatcaagatttaagagctttgaaaaaaagattaacagcgcctaaaatatggatgatatcgagtgatgacagagagtatcctgaatgtattgatcgaacaattttatttaaatcgttacaagatcaaaacagtcatccttatcaattacaatttattgccggactaattgctcaagaatattcacgtttgcatcagcttaaataataggaaagaatgacttttgttaaaagtcattctttttcattttgttcattttcttgaataattaaattagtaatttctcgtgattccgtatttttagcgagttcagttttaaaagtataatgctgatcataggctgttgtaaaaaagcaagaatataatacatctaaaataagtgagatggattctagtgaagaataagcaccaatttttgaatatgatttttctcttgttgtaacccgtaaaacaatatcagctaatcgagttaaactattttcaccaatacttgttattgcgataatagggacattctttttctttaaaatattagcaattttaataatttcaccagattctccagaatatgaaagacaaattcctaaatcattagaattggccatcattgcttcttgatagatattgctatttaacacaaaaacttcagcatttttaccgatgtggcgtaatttaaaaacaaattcttcagctggaaatgataaattagaaacaccaaaaactttaacagtattacttttttgtaatgctctcactgctttttgcagtgtatcgtgatgaattaatgaaagggtatcattaagactttcagtttttaactgtgttattttgttagcgatattcataattgaatctgtttttaaaaaaggttgattggcatctatatttaaatgacttttgtgcaaatattgaacttcttctaaaaaggcgtttttaaaattattataaccactgaatcctaattttttagaaattctaaccaatagcgatggtgaagtatatgtttcaccagcaatcatcgttgtcgaataatcttttattcgctcttgttttgttaagataaaatcaataactatttcttcacttggagaaaattttgtgtttttcattttttcttgtaatagcattgctcgccctcctggtattatcgtttctattatattctatcataacaaatatgataagcaatggattaagcaaagcggtttgtaaaaggcttttacaaatgatacttgtatttataaagataaatgagaaagcttttctaaaaggataaaactagctttaatgtcatctttatttgaattaagataggtttatcaaaaggaggaagatttatgaaagtagttgttattggggcatgtggacatatcggttcatatttagtgcctaaattagtgaagggagggtttaaagttgtagcaattagtcggggtaaaagtaagccatacataaatgatcctgcttggaagatggtagaacaagtagttttagatcgtaataaagatgaagactttgcttataaagttgctaaaatgaatgctgatattgttgtagacttaatcaactttaatatcgaagatacgaaaaaaatggttacagcattgaaggaaattaagatatctcattatttatattgttcatcgatttgggctcatggtcgagcagaatttttaccagctgatccaaatagtttaaaagagcctttggatgattatggagttgataaatatcaaagtgagttgtatttaaaagaacagtatcgcaaaaatggttttccagcaacgataattatgccaggtcaaatttctggaccaggctggacaattattaatcctcttgggaatacagacttttcagtatttcaaaaaattgcaaatgggcaggaaatctatttaccaaatttaggtatggaaactttacatcatgtccatggtgatgatgttgcgcaaatgttttatcaggcaatcactcatagaaatcaagcattaggagagagttttcatgcggttgaaagagaatcaatgactttatatgggtatgctaaagcaatgtaccgttattttaatcaagagcctaaaattaaatttttgtcatgggaaaaatggtgtaaatatgttaatgatgatgaattaatagatcatacttattatcatattgcaagaagtggggaatatagtattgaaaatgcacaaaaattgttagaatattcacctaaatatacaaccttagaaacagtggaacaagcagtagccagctatattgaaagagggattattaccttataattaagaataaatataaataaaaagagcataatgattttatagaataaaaggagcgtacaaataatgattgaaccagatactataaaattattacgagaatgtgatgcagggattaagatgggtgcagcttcaatcgatgatgttttagattatgcacatgatgaaacgttaagacagcatttaattgactgcaaaagagaacatgagcagttaaaagaagagattcaaactcttttagataagtttcatgatgaaggcaaagaacctaatccaatggctaaaggcatgtcttgggtcaagacaaatgctaaattggttatgcatgaatctgatcaaacgattgccgatctaataactgatggatgcaatatgggagtaaaatctcttaataaatatcttaatcaatatgaagcagctgatgaaaaaacgaaagatattacaaaaagattaattaatcttgaggaaaaattagtaattgatattcggcagtttttataaatagcaaaaagccttttacatatagtaaatggctttttttattgttgaacttaatttaaaagatagatcgaaagatttaaataaccagcaaaagttacccaaataagatatgggagcattagatagccagctaatttatttgttttgtaaaataggattgctgttattaagataagcagccataaaattattagccaaataaaggcaagtaagtacaacctaagattaaagaagataataggccaaataaaattgaaaaaaagctgaatcttataaatgaaaagagttacatgctgagaagactctgtagtcaagactagataggatgctattcccattaaaatatatagaacagtccaaacgattggaaatagccatcccggtggtgatagcactggcttttgaattgtttcaaatgtggtcatagcatcgtgtgtaagaaatgctgaaagagtacctacaaaaaggggaataataatacatataattaatttctgccattgaatttttataaaatcacctcatcaaaaatatatgaaaaaaataaaattatatgcttgttgataaaatttagggtataatatcctgagaaaaagagttttagagaaaaggtgattgtagattactgaggttgtggtaaaataattatgtgatgagctagatataaggaggaataatcatggcattatttgatgatctaagtaaaaaagcagcaaaactgacagaaaaaacaattgaaaaatcatctgaattagcggatgtcgcgaaaacgagagtgagtataaaaagtgctcaggctgatttagatgagaagtttattgaattaggcaaactgtattatgaaattattagtaatgataatatttttgatgaaaagacagcagcaatcgttcaggaaattgacagtattaatacacgaataaaagaattagaagcaaatttggataaataaaacctgttgaggatcatacttcaacaggtttttcatattctttttcaatatcatgccaaaattcagcgtttttaattcctaaattatcagggtggaaaattggatcttttccttcctttttttgaatactatagtcttttaaacatttaaaagcaattttacctaacaataaaattacgacaatattcatgattgccataaagcccatcaaaacatcagctagatcccaaatagtattaaaactagcttgggcaccaaagaaaattataattacagtaataattctaaaaataaataaagcttttttgttgtcaataataaatttaaaattactttcagcatagcaatagtttccaatcaaagaagaaaaagcaaataagaaaatagaaattgttataaaatgaataccaaattcacctacttcagcaaaaatagcttgttgaacatacggcattcctgttaatccagattctgtcccataatttagtaacataaaagcagtagtggaacaaattaacatagtatcaataaaaacagagatggtttgtactaaaccttgttttacaggatgagaaacatctgcggttgctccagcgttcggtgcggatcccattccagcttcgttagaaaaaagcccacgtttgattccatgcattacacaagagccggcaaatcctcctgcaatcgctttaaaatcaaatgcttgattaaaaatatcactaaatatttctggtagctgattaagattgctaaaggttatgtataaaccaagtaatatatataaaatagccatgactggtacaactttggagctaatgatcccgattcgatggactccgccaaaaataaccgcagcagtagctaaagctaaaactgcaccaataacaaaggcaactaattcattgtttgaaaaataatattcgacggcactactaacattatatgcttgcaatggattaaagccaaaaataaagcaagcaatcaacagacacgaaaaaataattcctaaccagcgttttccgatagctttttcaatataataagctggtcctccacgaaatgagtcgccgtctttttctttatagacttgggctaaggttgattcaataaaagcactggctccaccaatcagagcaattatccacatccaaaaaatagaaccagctccaccagcagccaaagctgtagcaacaccagcaatattaccagttcctactcgtgatgcagttgaaatcattagtgcttgaaaagatgaaacaccatcatcatgatgtgatttttccttaagaagtcgaattccttctggtaacattctaaattgaacaaatttagttcgaattgtaaaatacaccccggttgcaacaagcagagcaattaaaatattgctatataaaaattcattgattaatccaagtaattcttgaattgatatcacgcattcacttcctttcattaattaatcttgattataaagcgcaaaaatgcattataatcatacttttgtatgttaccatgtttgatttctactgtaaataagaatgcacaaaaagtgtatccattaggatacacttttagacaaattattgatgatacttatcctcaaattcttgtaaaggaattggtttagaataataaaacccttgaataatattgcagcctaaacaaaccaacagttctatttgtttttcagtttcaactccttcagcgacacaggcaacattaatttttttacacatttcaattatatgatgtaagatagtttgacatttatcgttatttactaatgtgtcgatcattgatttatcaatttttaattcatcaaaatttaaagttgataataatgacatatttgcatatttagcaccgaagtcatctagtgaaatattaaaaccgagatctttaatgcgcttagaaatcgtagcaatgatactacgatcgatatttccaatgctttcagtaatttcaagagttatgaaattattaggaatattatacttatttttaattcgttttaaggaattagtaaagtcagattctagaagggtaaggcgagaaatattgacagaaataggaattaattcttttccttctttttgccaacgctcaagaatttcacaaatttgttcaaacatataaaaatctaagtaacgagtcagtcgttctttttctaatgtgggaataaatttatttggcatgattaagccgtgaccgggatattcaagtcggaccaaagcttcggccgaaacaactttgttttgatcaatatcaaattttggctgtaagtaaacaacaaattgttttgctttaaaacatttgagaagattttcaagttttttaggtgaatagtgttttttatatgtatcagctcgttcatagtatatttgtttgttgatcatcattaattcttcggcttggtgaatcaaatcattaatatccatgttatcttcactccatgtgtatccaagtgagacaccatttggagttgaaccgagtaaagtatcttccatctgcttagtagcttcaataaattgtttatactcaagatcgtttacaataatgatgaattcatcaccacttaatctaaagattttttcgcttgggaaatatgaattcataatactagaaataatcgtaattattttatcaccatggtaatgtccaaaatcgcgattaatttctttcaagccgttgatatctgcaagaatgactccttgagagtaaacagcactattttcataactcaaaaattgagtaaaactattacgattaagtaagccgcttaagttatcgtgataaagattgtactgtgttttttcatataatcgacgtttctttacctcgttgacgatagaaaaattgatagaatcaagtaatgcaattgtattttggttaattgaaggattgtcaacaccaatatagcctgcaaaaatgccagtttcctcatagggaattgtcactaaagaatgggcttcacgactaataaagtgtgcatattctcgaggatgctcttttttgatggcttcacaatcattgataattagattattatgatgttcaaaagcttcataaatataaggaatttcatttaaatcaatccgctgtagttggtcacgatagtgaggatagttttcttggcaccattcataagtgtttgaaccaatttttgtatttaggtcaatttcaacgatatatgctcttgttgcttggtaaaaattgccaatgatctctaaaacgttgttaatagcttcttcaagagtgtccggaattgtcaaggcttgaagacaatctaaaatcgttttttcaattgcaaattcagtaggaacacgttgaagattgaagttatgagtatcagaaacatcaacagcaatttccattcgcacaggtgttccttcccataatactaatttatctttaacaatatagtccttatttagatgctgattgctaaactcccaaatataaaattcattaagatttaatttagcattagtacaaaatgggcaggggctagttcgaccttgtagagcttcgtaacatttaatatgattatattctcccgcttcaattccggtgatttcacgtccctttcgatttaagtatagtaattcataagtatctaggctgctaacataaacaatttcatcaagttcatcaattagccagcctttactaatataattagttacaggagttatatcctgatagctatcattaaaagcaaaatattgcgatttgcccagtttttttgctcgatagagagcagaatcggtttgttcaaacaattcgtgtaatgttttaccgtcatcagggctaaaagtaataccaattgaactgctgatcgtatattcttgataatttgatgagtaataaagatgaagttcttcaagaatgatactagctttatggtaaacatatttcttggatggaatatctttaatgaaaataatgaattcatcgccgccataacgcccaataattgctttgttattaaaaatatttgttagcttatgagcaatctcacataaaacggtatccccaaaactatgaccaagattatcgttgatatttttaaagttatcaatatcaatcaataataaagcactactagactctctttttttatttaaatattcattaacaatttgaccaaaagcggttcgattgtatagtttagtgagcggatcggattgagattggcgcaataattctaattcatgtattttcttatcattaatatcttttacatagacaaagccaaataatttatttgtttcaccaacgtgtaagagatgaatcgttgtactgacccagccttgtttttgagttgcattgagcgaacgatattcacaatatacttccgtaatcccctgttcaaataatttctttaaacggtgaggatgtaattcttggtagaatttatttttatcatcaggatggacgcattttttagtccagcgaagtaaaaactcactataactacagttagtgtttaagtcaactagttttaacatgttaacggtattttcgataatatcttcgataattaaatcatcatcaatattaatttcataggatactaaagcatctgatgctattgctgctttaaactgtccctcatgaagatatttttgatgactgatttctagattttttaaaacttttttgttttcagtaatattttcgactaaacaaattatatatactgactgattattgtatataaaggatagtctggaacgagtccaaatcaagtcattatctttattaaatgattgagtctcaatttcgagaaattcttctttcttttgaatgatactagtaattgtattttttactttttgataatcattagaatagggaagagaatagttgaagccgtcattacgcttgtatttaaaaagttgataataaagatcattagcatattcaaaatgaaaattatgacgatatgtaatgattgcacaagcagtatttaaatggttacagatcttagtgatcatatcaagattatatggattaactggcattctattttcctccttattaaattagaaaaaatagctctacctcattatactactaaagcaattatatcggttgaattattttaatgtttgattaatattccagcaatgatctaatggtccactgccatgacctaggttaagattagcttttaaagccccggtaatatagactttagctctagtaacgctttcttcaattgaatattctaaagctagattggaagcaattgctgaagaaagggtacagccagtgccatgagtattaggattattaattttttctcctgtcaaccaagtaatatttccccggtaataaagaaggtcatcagcccgttcttcaaaatggccccctttgatcaaaatgtagccgtggtaccattcactaatcatctttgcggctgtaatcatgtcatctttagtattaatttttaaatttgttaaaacctgtgcttcagggatattaggagtaataatagtagctaatggaataagcttttctttcaagagtcttagagcattgtcagctaataaacgagatccgctagtagaaaccataacaggatcaacaacgataggacaatctttttgcgatgttaatttatttacgatcatttcaattaatactggactggaaaccattccaattttaattgcatcaggataaatatcttcaaagacacagtcaaactgttcggctaaaaaatcaggttttacttccataatatctctaacacctaatgtgttttgggccactaaggcagtaataatactcatcccgtagactttatgagctgtcatggtttttagatccgcttgaactcctgctccacctgttggatcagttcctgcgatagttagaacttttttcataatcatctctccatttctgataaattttttaaatttaaatcacttattttgcaaatttcatcccaatcatcttgattactttgatctgcaacggcccatactgtaaaaccttgcttttttgcagcaattattgcatgaagggcatcttcaataacaatgcattcatctttatggaggtgtaatgcagagattgcataattgtaggcctcgccactgcgtttatctaaagtagtatgatcacatgtaataatttcatcaaattttgatgttagattatatttatcaagaatgttaattgttgcttgataattatttgcagttaataagcacagttttttatgatggttaaaacagttagtaataaattccaaagcccctggttttaaggggatttcgcttaaataaatatgatttaataaactattaacttcattgattaaaacatcaagaggctcttttaattgatatgtctcagcgatgtatttaattgcttggttaattgatagtggtgccaagatatctttaagatttgcctcaggggtaattccttttaattcgagaaaacgactgcctaattcattccaaatgtgcatcgaatcaagcaaagttccatccatgtcaatgatataacctttaatcatagattcctcgggcacgtgcttttaatttagcggctgcttcttttatatcaggagcgctcataatggctgaaacaacagcaataccatcaatttttgttccttttaagagtaggcaattgtcttggttgataccaccgattgctacaacaggtaagccaatttttgtagttatttcatgtaattgggtaaagctcactgctgtagcatcatctttagttgaagtattgaacatggctcccactcctaaataatcagcaccatcttccttggcggcaagagcttcttttaagttgtgagcagaaaccccaataattttatgaggaccgattatttttcgaactcttttaacaggctgatcatcttgaccgatatgaattccatcactgtctacagccaatgctacggctacattatcgttgatgataaagggaatatggtatttagaacaaattgttttgactttttttgcttgaatagtaaattcttcatcagttaaatttttttcgcgtaattgaaccattgttactccacctaaaatagcttgttcaatatcttcttcaagtggacgatcgttcaaccagctgcggtcgctgactaaatatagttctagcatgtttctagtgaagttcaattttaacaccggctttcaattgataataattaattgtactcaaggcatcgattaaatgcattctaaaactgcttgttccactattgtcattacgaactctttgatcagctaactcaccacagtatcccatcattgcaatcgtataagcagtagtttctaaaagatcattttgaccaatagcggttgttgctccaagaattgccgataacatacaacctgttcctgtgattcgtgacatcattgcacaaccgttagtgattacataggttttttcttgattggcaacaatatcaattgctccagtgattgcgattacggcaccgctttcttgactaaatttcttagcaaaactaataacttcattaagattttcagctgttacaatatcattgatattggcatcgactccttgagttgaagtcatattcattgctagggcttttatttcggaaatatttcctcgaataacactaaaattaatttcttcaagtagtttttttgcagtattagtccgaagcttgctagctccagcaccaacaggatcgagaacaacagggtgatttaaatggttagccatttttcctgctttgatcattgaagcaactgtcctttcattcagcgtaccaatattgattactaaagcattacagattgttgtaatttcctcaacttcatgaatgtcatcagccataatggggctgccattaacagctaagatggcattagcacaatcattgacagtaacatagttagtaatgcaatgcacaattggattgcgtaatttaatttcttctaaaactttttcaaacatattcttcctcactttcttaaagcactaaaaagagaatatgccaagtgccatattccctacttattgttagtgagtatgtccctacgttggcattatccaaatcaggttagcggtcgaagttcacaacttcctctcagcctgtttacaagctcccgtgctttaactatatcatagcattttcaaactatttcagcaaactaagtatcaaaattttttttgcgttgataataaaagaagattgaaatgcataattatatcgagtataattagtagggttagcgttaaaacccagaacggagcgataaaatgaaaaataattatgatgttgtggttgttggagcgggaccagcaggaatcatggcctgctatgaactgtatttgaaacagccggaattgaacgtattgcttatagataaaggtcaggatgttatgaaacgtcactgtccgatcaaggaaaagaagatcaagtcctgtccaatcatcaggaacaatgaaccgggctgtcttcctgcctgttcgattacagccggatttggcggtgccggtgcctattctgacggtaaattcaatattaccagtgaatttggcggctggctgactgactatctttcaaccaatgaggttgaagatgtaatcaactatgttgacaatctttatttaaaacacggagcaaccagagaaataacggatcctacgactgacaaggtcaaagaaattgaacatcgaggctatgcagtaggattaaaactgctgcgggccaaggtaagacatttaggaacagaagagaatctgcggatcatgacagaaatgtcaacggaactgaaagaacatattgatatggcatttagaacagctgtaaaggaagtgctggttgaagacggacatgctgtcggggtagttctggaaaatgatgaggtcatcaaagcgaagaagatcgtactggcaccgggacgagacggttctgcctggctgacaaaagtactgaaacagcatggactggagctttataataatcaggtcgatataggagtgcgggtagagaccagcaatatcgtaatggaagagatcaacagcaatctgtatgaaggtaaatttgtctataatacaagtgtcggaacaaaagtaagaacattctgttcaaatccgtcagggcatgtagtaatagagaatcacagcgggacgatgctggcgaacggacatgcctatcatgatccgaagctggggagcaagaataccaactttgcgctgctggtatcccataccttcagcgagccgttcaatgaaccgaatgaatttgcacatgaggtgagcagactggcgaacaagctgtcaaacggatcagtcatggtgcaaagatatggagatatcaagaaagggagaagaacgacttacaagcgtttgaaagaagggtatacagagccgaccttggcagaggcggtaccgggagatctggggctggtattaccgtacaacacgatgaaatcaattatcgagatgattgaggcactggataatgtaacaccggggatagcgaatgagcatacgttgctgtatggagtggaagcgaaattctattcagcgcggccaaaggtaagagaagggtttgaatgtgaaatagatgatctgtatgtagcaggtgatggagccggattaacaagagggctggctcaggcaggagcaaatggaatcatcgtagcacgtcatattattgaacatcttaaatagtaaggtaaaaatcctgttttagacaggatttttctattttgacaggtgtagtatcatggtggtaaacttaataataagaccatagggaaggagaaacttaaatgaatgtttttgttacttcattattaaaaataattaataatccggatattcaagatactaattataatattgcttattatttattactgcactattatgatgtttttgaaatgacacttcaggaaattgcagatgcatgttatgtttctgtttctactctcaatcgcttttttagaatatttggatttaaaaaaatttcaattattaaagatttaatgcaagtccatgcggcggcacgaataagtcagttggaggaacgttcgattcgcaaaaataatcaacaagttaatcagcttttaaaaccgctattagataacgatgattattggacagtatcagatcaaggattaataaatcagtgctgtgagatgattaaaaaatgtagccgtgttattttaatcggttcgaatgagatgatggattcattattgcgttttcaaggtgatatggtgatgatgcaaaaacttgtgattcaaaatactatttataataataattatatcgaacctcaagcggatgatttaattattttgctttcaatgacaggaagaattgcggagttaaaaccaactttgattgaacatttattagtggggaaaaacaatcttatttgtgttggctataaaaattttctttgtgaaaaagccctatttttaaaaattcctagttacctagatgagacgctagaaaatatgattttagataactattttcaaaatatagcttattgttattatggtggttattatgataataggtaaactaaacttaattttgtgtacttcttcatataatagtaatgattatcttttagcagcgtatctgatcaaaaaaagtaatcagattgaatcaatcaagatggttgatattttaaaagatacaaaagtatcaaaatcaactttattacgttttttaaaaaaattaggctataaaaactacactgacgttcaatacttgattactaaagagaaaaaacatcaagaaatatttaaagagagaattattgagaaaaatttaagagataagttagcaaaaaaacaaagacttatagtaattggtgatagttactcagttagctcactaattgtatataaacaaaagttttatgaaattgggatagatttagatatccaattatcattaaagtcatatggacagatggtagttgaaaaaaagtttactgagagtgacttaataatagtcgtatctctatataaaagtgatttggatttaatggcagaattttttagtggctatcttgaattgaaacattttattaaagaacaaaagattgatcatttatatgtaggaaagattgcgacggggaatcgtaatcttgatgagtgctatagaattgatgataacattaattttagtgaagcaatttatcagctttgtagtttgtttgagaaaatttataatttttatgctttgtaaggttcaaaatatgcccctttttattatttatcaatgattttctttattatagaaaccacgccaaataaaagcaatttcaaaatgaggttgtgataaaatattaatagaaaagagaaaaggaggctagatttatgagaagattaaaattagaaataatcagcttattatgtttatcatttatagaggctaatataacaacattgatggcagtagccagccgttaggtatatatttaccgcatgactatgatacaaataaaacttataagacaatttatcttgcacatggtggtgggggaaatgatgttgagtggatgaatatcgcttcagcaaataatattatggataatctaattgctgatggtgaagtggctgacgcaattgtggttactaaggataatacatattttaactttgaaaagggtgatagcctaaaaaatcttacagaatgcattatgctttacattgaaaagaattatagtgtttcagcaaattcccaagataaagtactagctggtctgtctagtggagctacagttacagttcaagcaatgttctatagtaatgaaacatttggctattatggtgtattttcaccgagtcgtacattagattttgttgaagaaacattaacactggaaatggttgcagcgtttcccaaagtatcacaatactatgtgagtgtaggaatttttgatatttttgttaggcggaatgtcaatgttcaaattaatgaagaattgataaaagccggagctaatgtagtttttgaatggaaaaatggagctcatgactggggtgtatggcgtagtcagttcagtgaatttgtaaaagattatttgtgggatcgtgaaacagtagtttcaactccatctaatcctgatgccgatgttgctccccaatcaaattcaacagctgctgtaaaaactggcgatagtgtcgatatgacaggattgttgatcataagcggtttatcattattaggaatttcaatacaatactattatagacatcgtaaaacacattaataaaaacttttaaataattagatataatctcgccaaagtagatagatgtgataatataatcttaccaagactatagaagtgagatttttattatggaaaaaattgaaaggtatagcaatatatttaagttttagaaagaacaaaaattaaagaaaggaaatcattaataatataagactattgctaccccataaaatgctagtttatatctagtaagttaattatttttgaccatttgacaatagatacatataaatttataacatgactttttatttccctattgacaggtaggaaatagtttagtatactctattcatactataacagtaggataaggggaagaaaaatgaattttgaactactacaacagctcagaaataattttcggaatggacgaatgtattgttttttataaatcatagataacaaacattaagaaaagaggaaaataaaatgagtaaagacaatttaagatttgaaactaaacagttacatgtaggacaagaaataactgatcctaccggagcaagagcagtgcctatttaccagacagcagcttatgtatttgataattgtgatcatgcggcagcacgttttggattaagtgatgctggtaatatttatggacgcttaactaatccaactgaagatgtttttgaacaaagaatggcagctttagaaggtggggtagcagcattagcagtagcttcaggagcggctgcagtgacttatgcgattgaaagtattacacgaagtggtgatcatattgtggcagctaaacaaatttatggggggacatataatttattagctcacacactgacaaattatggtgttaatacaacatttgttgatagtgatgatcccgagaattttaaattagcgttacaagaaaataccaaagcgatttttatagagtcattaggaaatcctaattcaagtttagttgatgttgaggcagttagtaaaattgctcatgagcatggtattccattaattattgataatacatttggaacaccatatttatttaggccaattgaacatggagcagatattgttgtgcattcagcaactaagtttattggcgggcatggaactactttaggtggtgtaattgtcgattctggaaagtttgattggcaggcttcagggaagttcccacaattaagtaaacctgatccaagttatcacggtgttatttttactgaagctgctggagctgccgcctttgtaactagaattagagcagtagtattacgtgataagggagcgactatttctccgttcaatgcttttcttttattacaaggattggagacattatcactacgagtagagcgtcatgtagaaaatgctttaaaagtggttgattatttaagtaaacatcctaaagttgcaaaagttaatcatccatcactaaataatagtccttatcatgaattatatcaacgatatttctcacatggagctggatcaatttttacttttgaaattgctggtgacgaaaatgatgctaagaaatttatagataatttagaaattttttctttattagcaaatgtagctgatgcgaaatcattagtaattcatcctgcttcaacaacgcattcacaaatgaatgaagctgaattagcagcatctggaattaaagctaacactattagattgtcaattggtttagagcatatagatgatttgttagaagatatcgaaaatgcatttgaccatgtataaaaaataaaaatacgtcaataatataactagaaattgttgttgcttaaaatttctattgaccaaaagctatcccagaggatagcttttaagttattagtggcttataatgtaattgaggtgatcattatgagtgagttaactaaaataccttatgttggtaaagcaactgctgcatcattgaatttaattggttatgaaacgatagcttctttaaaaggcgctgacccagaagaaatgtatcaaaaagaatgtgatgttagaggacaaatggtagatcgctgccaactttatatgtaccgtatggtagtatattatgcaagtagtaaaaatccagatcccaaaaagttaaaatggtggatttggaaagattgatattgacaataattggaagataagttaagattacaaagatgaataaaggcgatgaatagaggagtaattgtattttatgtgtttaagagagtctcggctggtggaatgggataacacaggatataatgaaaaaagactaggagctgtatctaggatattaaggttgattagataacgtgagccacgttacaggcaaaactattatttgatagttgttgaggttaataaggtgacttattaacgaattagggtggtaccacgatactctcgtccctttagcggatgagagttttttatattttaggaggaaaaaatggaagaaagaaagtttagcgaacaagagttagttcgccgtgaaaaattacaagagctagtagataagggaattgatccttttggacaacggtttgatgttactgcatattcaaaagaaattaaggaaacttacggtgataagacgcatgaagaattagaagaaatggctgttgaggttaaagtcgctggaagaattatgacaaagcgtcgcaaagggaaagtgtgcttcatgcatattcaagatcgagatggtcaaatccagttatatgtacgtaaggatgcagtcggtgaagatgtttatgaaattatcaaaaaaggtgatattggagatatcgttggtgtaaaaggaaccgtatttatgacaaatacaggggaatgttctattaaggttgaagagtatactcatttaactaaggctttacgtcctttaccagaaaaatatcatggattaagtgatgttgaagaacgttatagaagaagatatgttgatttaatcatgaatgaagaagctcgtaaaattgcttttgcaagaccaaaaataattcgttctattcaacattatctagataatcaaggctatgttgaggtagaaacacctgtattaaatccaattttaggtggtgccagtgcgagaccttttgttactcatcataatgctttggatatgaatttttatttacgtattgcaactgaattaggattaaagagattaattgttggtggtatggatgcggtttatgaaattggacgtttattcagaaatgaaggaatggatagaacacataatcctgaatttacaacaattgaagtttataaagcctttagtgaccttgaagggatgatggatttaactgaaggaattatttcaaatgcagctaatgaagtttgtggtacatatgagttagaatataagggaaataagatttctttagcaccaggatttaaacgtatttcaatgacagatgcaattaaagaaaaaacaggaattgattttgctgatcaattaagctttgatgatgctaagaaattagcagaagagcatcatattgaggtagaacctcattttggctatggtcatattatcaatgaattctttgaaaaatatgttgaagaaacaattattgaaccgacatttgtctatggtcatccaattgagatttcaccacttgcaaagaagaatttagatgatccacgttttacacaacgttttgaattatttatctgtggtaatgaatatgctaatgcatttactgaattaaatgatccaattgatcagtatgaaagatttgctaatcagttaaaagaaaaagaattaggtaatgatgaagctaatgaaatggatttagattatgtagaagcattggaatatggattaccaccaacaggtggaatgggtatgggaattgatagacttgttatgttattaactggacaagaatcaatccgtgaggtaattttattccctcatatgaaaaataagtaagataattgcaagtgaatagagattgaaaaagctcgttataatcgtataaactcacgattttacgggctttttgctttgtgtgggaaaggagtgattttaaaaagaaaactgtcaaaaaactgtcaagaatgtgaggtggaaaaataagtaaagattgtcatcacagtgaggcgacaattcaaaacgattaaaataaataaaatattttccacgtagtaagtggaaaatcatgatgggaagaaatattggactcattgaatccaatattagaaagtttttatatgtgagtataagagtacggactaaagtactgactaaaaaaggctaccttatggcaaccttcaacctatgtatttgttatgtaagtgatactgttctagtaactgtaccattctttacatcaaattcaacaatatttaaattgaattttaatggtaatttatgacctgaaaaaagtccaataaacatttctattgtttgatctatttcattaacaacaatatcaacacgtttgaattcattgattttatcaaacatgaagaatggtgctatgaaatcagccacagttctttgatttacattttctccgtctttaatattacatctagcatgaaatgaatcaactaagattttattattaggctcacgttttttagtagcaacaccagaaaaaatcatttgtgaaccatctaatgtagtatatgaaggattaaagatgacattatatccattaaggtataaataacataagtatctttgatatacggaaattttattgatttcatcaggtgttaatccatttttttcagtaggtattgtacacagtatttgttgagcaatatcaattggttgaacttctaatatttcagctagtttatgtattgtttgcatacttggatttttaacattatcagcaagtatcttacgaattgcgacagtagtcatatctaacttgtttgctaattcatcaagtgacatatttgaattgtctattaaattttgcataaatgttgcataactcattatattcacatcctttacatgttgattataacatcattgaagtggaaaataaacactaaattaaataaacgcaaataaattattgcaaatagtttaaatctgttatatattatagttgtaaactaaaggcaataatatataatgcaaatagtttacagagaggagtgatgcttatgattgtattagagattgaaaataaaaaggttaattagccgcgtctggtaaacttgctaattaaccaccaaccgaaagaagaacccttaggtatttttctttcatttagaattatatcaaattttggttcttctttctatcatttatgaaaggagatttaaaatgccaagttatacacaagaagaattgttaaaaaaagattttaaagatgttgataaaggtattttcggtggattgcttagaagtggattatatattctaggtgcaacaagtaaagtcggaaaaacaatgattgcaacatcattagccaatgcagtagcaactggtacagaatatttaggaagaacgaacagaaaggggaaggttatttattttgataatgataactatgattttgaaacgaaagatagaatactagccctaaaattcgttggaacacctaatattagatatgtatttggagaagatgcatcaagtattcgcaatgttaaaaatgaattgaaatatgaaatagaggacttagaaaattatatattagtgattatcgattcatttattggactagatgaatttattgaagaagatcaaagttatcaaaaattatatccagttattaaagatttaagagatttcattatagaaagaggtttagtatgtattatcttacatcatacaaagaaaggtgaagcaactggacaagataagttaattggttctaaagcaatgactggtgcaactactggaacaattattatcaatgtagcaacagagttttctaaaacaggaacgctagaatttatcttaagacataaaaaagatagtattccaattaagaaagatgttgatgatattaattggattcttggcgaagatgaagaagatggaatggaggaaattccaagaaatattttaaacttaatcaacgcagtagtttctagagaaagcaaagaaattaaaggtacagcccaagaaggtgtaaatgaaactaaaatggaagtcaatcctttttctttgtttaagtatctagtaaaacacaaagaaattcttgaacaaaattatatttattttgaaaaaggcaaatcgggaaaaagatttattttagttcgatatgaaggagaaaacgtatgatttgggacagttggacagttacgaacgtatatgctttaaagtgtccgaagtgtccaatgataagattaaaattcgtgattaaaaaatcaaaagcaacaccaaaaaaatatggtgtagcaagttataccaaaatgcgtggcttttggaaacttgccctgctgggagcttttgttttaagtagtgtgatgtaaatggcacacgttgaaaagtatatgagaagtgatattacaggtttagcaattcattatgaacgtcgtgatggacatcagttatctaatgaagatattgatataagtagaaagcatttgaattataatctagcaagtgaattacaacctttaacatcagaacaatttatcaaacaacgattaagtgaagtgaaacatatcaatcgtaaagatataaaagtgatggtagattggattgtaactttaccaaagaatgtacttgaacaatacgaagataacttctttaaattcacttatgaatttttaaaagaaagatatggtgctaaaaatatagttggtgcatgggtacacaaagatgaaaaaacaccacatattcattttagtttcgttccagtaattgaagttgatggagttgaaaaattgaattgcaagacaataatttgtagatcagaattaaagaggttccatccagaactacaacaacatttagaagagaaacttggatatacaccagaaattttaaatgaagcaacaatcaatggaaacagaacgattaaagagttaaaacaacatgaggatctaaactttaaaaagagtataacgaatatcacgaatcatataaatgcaagtcaagaaatagttgcacaagcagagaagattgactttgaggcatcaggattattggaaaaaacgaaatcactaaagaaaagtaatgaagtgattgatgagtttaaatatcaaaataaagtattacaagcagataatatatctttaggtcaattggttgttgttcaaaaagaagaacttgattgttatcgcagaatgcctttggcaaaacaattaaaagagaaagaacaggtaattgataatttgtattcatccattggttcgctcgaaaaagagattgatgattataaatatgataattataaacttagagaaaacaatcatatagcgactaataagattgacaagttaaagcaagaaaaacatctgtttgaaacatttattgagatggtcggtttatcaaaggtgtttgaaactttcaaaagaaagtatattgcgaatgattatcaaatagatattcatgatttaaaagatatttgtgagaaagcaatttccaaagtgaaaaaagtgtttgaaaccatctcaaagagaattgatttcttgaacaaaaataataaagaacaggatgaaataattattcatcgaaagaaaaacgaagaacatttacgttaggaggtatattgtatgacagatttaagaatgtatacacaagaagaagtggcagaaatgttgcatacacatattggtacgattacaacattaagagaaattggtattctacctgcaattagaactggtaagaattatatgattactaaagaaagtattatggagtttcaaaagaattatgctggattagatgtttctaatcgtgtaaaagcaattgaagcttatagattagttaaaaatagattggaggcttaatatatgtcgattcgtaaaagaccaagtaagaaagcattgtcggggtacacttatcaagtgtacttcccatatgttgattctatgggaattcatagagaatattttaaaggtggatttactacaaagaaagatgcgcaaactcatgaagcaattaagcgaaaagagtttatggattatggtgatgtgttggcaaatagagaaattacttttaatgaagtgtttgaggaatatatggaagtggaaggtatggcgaaatatgctcattcaaccaaactttattatcagaatacctataagaaacatattaaaaatacaattggtatgtgtaagttaagaatgttgaaatataaagatattcagaaatattttaatgatttaaaagttggtttaagtacagcaaaaaatattaagaaagtatttcatgtaacatttaaatacggtttgcgtgctgattatataagagaaaatcctatgtcttatgtacagttgcacattgaacctaccaaaaatgaagaaaaggaaacaattgtgattacaaaagaacagttagatgaaatgttacaaaagattattgtggtaaataaacatactcgtgattttgattacacacagtttaactattactcatatgcagttgctttatttatcggttggtatactggacttagaattagtgaaaccttagggttaaagaaaagtaactttgatttagaaaataatacgattaagattgaaagaagattgcagtatcatggtgtacgaaagaaagatttacatgatacaaagagattgaaatcaaagaaagcaaatgcgatcttgcctatggcagaaaagttaaaagaaggtttgaagatttggtttgagaaaaatccatacgataatgtaatttgtgatatttatggtaataagattttaccagcatctatgaattatcgtgtcaaatgtgttgcagttgaaatgggtatcccagaatttcattatcactgtttacgtcatacattttctactgcattagcagataatgatattcgaccaagagtaagaatggagctggttagacattcaaatattgatttaactgaaagagtttatatgcatgtgaaagaatcaagcaaagtaaaagcgattgaaaatgtgtttggaaaggaagggatgtagtatgaataaaattgaatatagcaaggttggggattattatatccctaaccttaaagtaaaacctagaagaaatgtatcattaggtaaatatggaagaatgagattaaattatttaaaagaacacgagagtgcacattacaatgctctcttgatgaatgatgaattatatgatcatttgattgagatagataaacaagcttatgaaatgcacgatagacttgttgaacagtataaagaaaaatggacaattactgaagaattaaaacaaacgaatcaaatggaatgggttagacagatgaatttgataaaaagaataattgaacaaattgtgtatgatgctcttattatgaagtaaaaattactccccatgaaacgtggggagtagtttatttagataaaacaaaaatatattcatgagctaagagataaaaattaagattttgtattttgttttgccagtattttgttgaactacaattatgttgttccttgattataatctcttttaaagtgaagccattatttaagaaaacttgcattgtattaaaacctaaaggtataacattcccattttttctaatatcgccaatcataaaagaacaattatgtccttgttttaaaacacgatacaattctttactcactttatccatatgtaataaaaaatctttataatctagtaatgataaatcgttctcaagatttttactatatttgattatatttgtataaggtggatgagtacagatgaagtctattgaattatctttgagcatagtcatttttttagcatcacattgatataattcgattttagcagaattgtgacaatcaaaatgtaatcgttttttagaaatattgagagcatcattgttaatatctactccaatagcatttctatttaataattttgcttcaataagtgttgttcctgaaccggcaaaacaatctagtataagatcattctgtttggtatatttgagaattaaatttttagggatatgaggagaccaatttcctctataatcgcctttgtgtgtagcccaacttcctcgatcaggaaaactccatatagttgtattttgtaattcgtatgttttcatataaaacacctcctattatatatatacgtagaaaaatacaaaattcctttaaaaaaatgcaaaaagatttaattttctttagttgagtttatttttccttgaaaaaattcgtttttatttagttttacctgagaatatgataaaatagccatgatataggaaggagtgtttttaatggcaaatcagaaaaatttagtattaagtccagttttaaaatgggtcggtggcaaaagacagctattgaatgatataattcctatgatacctaaaaattgttcaacttatgttgaaccgtttattggaggtggggctgtattatttgaattacaacccaagaaagcgataataaatgattttaatagtgagttaattaatgtttatacagttatcagggactactctgaagaactaatcaaagaattacaatttcacaaagataataatacatcagaacacttttatgcagttagagaatatgatagaaaaccagaatttttttctcaaatgacccctgtacaaaaagcagcaagagttatttatttgaataaaacttgttataatggcttgtatagagtgaattctgctggacagtttaattctccatatgggaagtacaaaaatccaaatatagtgaatgaaacggtcattagagcgatgtcaaagtatttcaatgaaaataatattgtcattaaaaatgaagattttaaagaagcattaaaaggattgagaagaggtgcatttgtttatttagatccaccatacatgccaatatctagttcatcttcatttacaggttatactgaaaatggttttaatgaagacaaacaaagagaattaaaagaattatgcgataaattagataaaaaaggtataaaattcttacaatcaaattctgattgtgaatttatacgagagttatatagtggttatagaataaaaactattaaagcgaaaagagctattaatagtaaagggaattctagaggagaaataaatgaggtgttgatatacaattatgagtaaaaataaggatttatcagtagatgaagcttgggaaaagttattagaaaaatatgacattgtaaagaaaatagaagaagatgggatatttcatattgaggcttcacaaataaaagaatttaaagagccgagattaatgtcaaaatgggatagttcagaacaattgccttctgctttgaagcgcaataaaatcaatatcttgcctaatagtagacgttcttatgtattaggagattttcttttgtaccaagatattcctgaactggaagaacatgtaacaaaaatgactgcagtagaattaccagaatatgaaagtatagatattaacaatattacatctgaagctaatgcgattaatgtattaatattatcaaaaatattagatgactttttgggtactgatgaaaatgttggtacatttaatgggcgtatgggtacaggtacatttgatttcgatgttaatactgtgggaggatcgaaacaacatattctagtcaataacgctcaatgtgaaatagatggttgatttgaaaattcagagtcagtagtaattatggaagccaaaaatgtagtccatcctgattttcacattagacaactttattatccatatagattatggaaaactaaagttaacaaaccgattagacttgttttctcaatatattcaaataaaatttatcgtttatttgaatatgaatttactgatataaacgattattcatcaatcaaattgattaagaataaaaactattctcttcaagatacagaaattacattagaagaactaattgaagttagaaatgctacaccaataaagtttgatgataatcaagaagataagagtttacctccatttgttcaagcggattcatttgatagaataatttctttattagagaatatgaatgataatccaatgaatgatgaagaaatagcagagttaatgcattttggttctaatttaagtaacggaaaaccagttttcagacaatctcaatattattacaatgcaggaaagtatttaggattatttgaaaagattcgtactgaagaaaatgaagtgaaatcagttttaacatctttaggtaaaaaaatttataaaatgcaatataaagaaaggcaattaaagttagtttctttaattttagaacatcaggtatttgctgatttctttgatgagattattgcgaattttggtgaattacctgaaaacaaggatattcaagaaagaatgagagaattaaatgtttgcaacgaaggacagattgctagaaggtcacaatctgtaagatgttggttgaagtggattttcaatttaattagattatcataaaaggaggtaatttagtgaactttttgaataattttcaatctgaattaatttctcaaacatcaatagttcattatattgaatttcaatttgaacaagaattaaacaaagtaagaagatatcttaatgttgaaattaaagatgagctttataataataattcaaattatatgaagttgattctttcgacttgtgatgagttattaagtcgaaattctaaatcttatgttgcagagaaagagttacctgctatcgctagaaatgttgatgttagagaacctataggtgaagtgattgaatattgcattgaaaccttggaagccggaggagaattaggagttgctgagttaaaacaagaattagataaaataaacaaagaaaatgatgaagattattgttactatgattttacagaacagcagatagaagaaatgattgattctgcatacattattaaagattatagaaaaaattatgaattgaaagagcgagatgaatgatcaattcatttaaaactagtattaaacttgtagataattcatcattatcaaatatatttagacaatcttttataaatattttttcgatttttgatgcttatgtatttgaatatatagaagaattcttttgtgcttatccaaaagaattaagcctatttttagaggtgaaaaataacgaaaaattaaatttactttagacgaagtagtagattttgaagatatagaaaatctaaaaaacgagatgatacataagcaacttgcaggtagatacttgagcgaattaataaataaattaaaaaaatatagaccttctctatttacaggtgttgaatatccagtgttaatggaaatgatcgaacgtagaaatattcatttacataataagggaattgtggatgaaaaatattgtggtttttttaatatatatcatttttgtgatggagaatacgcatttattgatgataaatatttattcactatagtttttaatacattatctcaatttaccaaaaacatggaaaaagagttgaatattgataatgtaaaatgatgatttaaaaaattattttctattaagagagtaattttttttattaatttattgacaatataacgaaatagcgttattatgataatgcgatatccggaatatcgaattatatataagtctgttaatattatggtgttaactagacagaaaagaggtaaatatgttagaaaaaacaatggtggtaaaagatagttcgtttagaaagttggacgatccatttgaaaatggaaaatcaagaaaatacgtgttttatgtaaaggttgatgatgttgctgaaggaattccaatgacaacaaatccaagagatcagaaattgacatcaaatgtagcaaaagcgattactgactctttgacaagcaacgatggatattttcatttgaaaaatagaggtattgttgtatctgcacaaaaagtgaattataataataaaaccggaaaggttactatttattttgagaatacacaatatcatgggaatatagatggaggacatacttataaaattgtatgtgatcacaaaggtgaaaatctagaccaatatgttcaattcgagataatgacaggggtagaagatataattgaaaatcttgctgaagcaagaaatacgtctgttcaagtagatgaaaaatcaatggcagaattagctcaaaaatttgatcctataaaagaagctttagaaggcatgcctttttatagaagaattgcatttagacaaaatcaaagttcagttgatgaggaaacaggacgaaatgaaaaaatgattgatgcacgagaggtagtcgctattataaatatgtttaatgttgataaatttactggtagcaatcatccgattcaagcctattcgtcaaaagcaaaaatgttaagtatctatttatctgatgtagaatcatatagaaaatatgtaaatatcattccagatatttttgatttatacgatggaattgaacaagagtttgcaaaggcatataatgaagctggaggaaaatatggtagaaagaaatattctggattcaaagatggaaatgtaattgcaaaaagtaaatttggattacatgagttacaatacaagattccagatggaataatgtatccagtagttgcggcatttagatcgttagttaaatttaacgaaagtacaggaaaatatgagtggaattcaggggtaaatcctctaaaaatctgggacaaatgtaaaacagaattagctagcaaggtgatgagttttgcttcttcaattggagataatccaaatgcagtaggaaaagatcaaaatgtgtgggatttagcatatatgacagtgcttttaaataaaagcaattaattttgtatcaataagtaaagagaataattaattgaatggagggatattcttgacatatgaaattaaattaaaggtaaaggatttgattgatgaaaaaggaatgacacaaaaaactttggcacaactatcaggcattcgagaatcaacaattagtgatatagtacgaggtacaagaacagttataaattttgaacatttgtcaaaaatagcggaagccttgaaagtaaatgatattagagaacttattgattttaaatagtaagtattgagaatgaacaaatatgaatagtaaaatatattggaataactgtcaaaaagctgtcaattttcttttaaatggtgtacaataaggatacacaaatgaaaatattaagtatttaagggatattattgaactgcttattttcctagataacgatactttttcaatctcacatgaagaataagtaaagtcatgtattttcttgtgagaatttcgtgagaatgaagcagatttcttaaatgatatctgctttttatatgcatgaatctaagaataatatcatttctttcaagcactataattacgatatattttacaaatatattgacgaatatcgatatgtatgttaatatcacatcgaagaagatagatatgaggtggtttgatggaaaaacagtttaatcaagatgctaaggtttttaaagcattctgcgatcctaatcgtttaagaatattagatattttgaaatccggtgaacattgcgcatgtaaattgttagatatattagatgttagccaatctacgttatcgcaccatatgaaactgttaactgacgctaaaattgtaaatgttagaaaagatgggaaatggtctcattattctttatctaaagatggtatacagtttgcaatagaatatttacaacagctcaaagtatgaaatatgtaaataagttaactgttgtataaattaccaccactaaataggtggaaatttatttgttttatacatcgaaatatatcgatataaggagggtgctatgagtcaaattttgctattttttcaagaccagattcttgggatgcgatggttaaatgaattgattggatcaatattaactagcattggattaaatatagatgaaaaaataggtgggatgttgcatttttttatttatgatagtattaagatatttatattattatcggtattgatttatattatttcatatattcaaagttattttccaccagaaaaaacaaaaaagatattaggaagattttatggtatttgggcaaatatattaggagctttacttggaacagttacaccgttttgtagttgttcatcgattcctatcttcatgggatttacaagtgcaggcttacccttaggcgtaacattctcgtttctgatttcttcacctatggttgatctaggagcgctgatattattaatgagcatattcggatggaaagtggctgtgttatatgttatagctggtttgattatatctgttgttgggggaaggttgatagaaaaacttggtatggatgaccaagtggctgattttattaaacagacagataatgtagatgttggttttgtgagcttaacagtcaaagatagacgaaactttgcaaaagaacaagtcatagaaacagttaagaaagtatcaatatatatatttgtaggtgttgctattggatcagtcattcataatgtaatacccgaacattggatacagtctatactaggtgatcataatttttattctgttccacttgcaacagtagttggtgtacctatgtatgctgatatatttggaacaattcctgtagcagaaagtctattgttaaagggggcagggcttggaactgttttatcatttatgatggctgttacaacattatctttaccatcaatgattatgctatcaaaggcagtgaagagaaaacttatgattgtatttgtggcaatagtaacagtaggtattatatctgtaggttttatgtttaatatattttcatttctattattgtagaagatatgtttaatatgagaaatattgtacattttaatataacgatggagattaattaaatgttaaaaagtggttttaactattcaattcactcagttggtggatgtacatgtttggggttataattaaggtaggacgggaaagaagattttgttaaagaaattattttagttataaatcaatatctagatgataaatggatgatggcagttcctagataagaaaatccattattagatgttgtctcaaaatttaattatgaataaaaggagaaataagtgatgaaattatttaagaaaaaagagaaaaattgttgtaatgttcaatgtggtgatgggagtatgaagagaggattggaaaagaaagataagggttcaagaattaaagtcttaggttctggctgtgctaaatgtgcaactttagagaaaaatgttaaagaagccttggatgaattaggacaggaaatgagtatagaacatatcacagattttacagaaatagcaagctatgggattatgtctacacctgcgcttgtaattgatgagaaagtagtatcttttggaaaggttttaacgatagaagaagttaagaatatcatattaacaatagatggatgaatcattgaaacaaggtgttttttgtgaaggggatttaagcgagatgaaattgcttattattgtttttatttaatattaaacaatttgaaagaaatgaataatatgccaagagtcgcatttatatgtgttcataattcttgtagaagccagattgcagaggcaatagcaaaattgtttgcttctgatgtatttgaaagctattcagcaggaacagaagtaaaaccgcaaataaatcaggatgctgttaggataatgaaaaaacgatatgatatggatatggaaaaaacacaacaccctaagttactagtcgatattccagaagtagatattgttataactatgggatgtaatgttaattgtccatttcttccttgcagatacaaggaagattggaatttggatgatccaacaggtaagagtgatgaagaatttggcagagtgatagataatatatttgcaaatattaatgaattatctacaagaatatccaaaatgaatatctaaggcaaataaaatttataggatagggagtaattctattcttgttgagaataattattatatatttcaactgacacactttccatctaatctttatacgcccataaataaaagtcatagattttccgtaaaaatagaaataaataatcttcaaaaatatattaaacataataagaatatgattaaatcagtactttttgattttataaaagatgtactattacgttacacatgaagaaaaaatagataaacaatcaggcaagatgtaataaggatattgttttatttagtacacaagttctcaatattaaaaaaggtaagttgaattgaaatttattttttttagtacgtataattagttgaaaaaattaacgacaggagaaaatatatgaaattataaaaaatataaagataatttgattaagttttggattgacactttcacatgttaagagtcaattttttaattaccatagtttagcaaacaaaattcactttattcctgctatacagttttattttcaacaaagcgctgcaataaatatagtaatgaattggaaatagtatcataaaatataaagtatataggtaaggaggaagtaaaatgaataataattatgagcttggaaaagtaattgtagcattaaatataaatattacttctaaagatgtactagactattatattgatcttgttttagatgggattgattatgaaaaagcagaaatcatcttccattcaaagaatactgaaagtctaaatgagggaactaatatagttcttatttatttaaaagataaaaatcctcatgcagttactaatgcagttgcaaaattatcatcaagtccatatattgtttatgcagaaccggattatattgaagaaatgcatattatctcaaatgatcctttatacaatcagctttggggaattcaaaaaatcaatgcaccgcttgcatgggattatacaactggtgatagtagtatcagtgttggagtgattgatacaggaatagatcaaaatcatccggacataagagaaaatatgtggactacgtggaatggaagattaatttatggctggaactttgcagataatagtagtgattcaatggatctagatggtcatggtagtcatgttgcagggacgattggtgcagttggaaataatcgtattggtattactggagtatgctggcaagtaagagtagcagctttaaaatttggtcttgatgttgcttcggcaattgcggcaatagattttgcaaattattataagatttctattttaaatgccagttggggtggacgagcttattcacaagctttaaaagatgccattgatcagtatgatggcttatttgttgcttcggctggaaatgatggaactaacaatgatgttgatccaatgtatccagcatcatatgattgtaaaaatattatttctgtagcagcggtcgatccctatgatactttagcccgtttttcaaattatggtcttaaaactgttgatatagcagcccctggaacaaacattctcagtcttgaccttgctggtgagtatagccccttgaatggaacttcaatggcagccccacatgtagcaggagcagcagcgttattaaaatcaagtatgccgaatatctcaacaataactttaaaaagaattattttatcaagtgcgatggaaaacccagaacttaagggaaagatattaacgggaggaatattagatatggaaacaatgtttaaactagctaactgctggcatggacgagaataacaatatatatctaataaaaatgtgatgaataagaaaaataggttataaaaacattttaactattctttaaataatttaaaatagaataaaggaagtgagaatatgtataaccctcaattagaaacatttataaaggttgttgatcgcggtagtttctctaaagctgctgaggacttatttattagtcctagtgctgtaattaaacagataaatattctagagacaaatttgggtttaaaacttctaaaaagaactcatcaaggggtatctttgacaccagcaggagcatctttatacagggatgccaaatatttaattaaatatgcaaaggattcaattgtacgagcacacaaggcgatggaaaaagaagaaatggtaataagaattggaacatcaaatacaacaccaagtcaatttcttatcgatttatggccgcggattcatgaattatgtcctaatttaaggattcaactaattccatttgaaaatactccggaaaatgctcgagaaatactagctaatttaggcgataatattgatttggttgctggtgtatttgaaaaggataatttcaaacagcggggctgtgattctctagaaataaaaaaagaatcaatttgtcttgctttatctatttatgatgaattaagtaacaaagataagctgtctttgtaagatattcatggacgtgaattaatgctgattaaaagaggctggaataaatatgttgatgaaatgcgtgatgatttaattaaaaatgatcctactattataatcaaagagtttgagttttttgatatctctgtttttaatgaatgcgaaaataataaaagtttgcttatgagtgtcaagagctggaaaaatattcatcctttaattaaaactattccagttgaatgggattattatatgccttatggtttattgttttcattagagccttcacggcaagttattgagtttgttaatgcagtaaaaagagttttagatatatagtatcgatataaccctaaggttatatcgatactacttattgagacttctatgtttataaataattatatattataaagatgcaaaagaaatataaatataggagaagataaaaatgagaaaaacgagaatattaggtcaaggattagaagtatctgctattgggcttggatgtatgggaatggatcatgcttatggggctcctgctgatcgtgaagagatgattaaattaattagacatgcggttactttaggatgcaatttttttgatacagctgttgtatatggtgaagcaaatgaagttttattaggtaaagcattggagattttccctcgagatgaagtaattattgctacaaaatttggtatttatggacaagaaatcgttgatggtaaaccacaaaatattttaaatagtaagccggattcgattagagaacaattagagggatcgttaaaacgactaggcgttgattatattgatctatattatcaacatcgagttgatcctgaagtagaaccagaaatagtggctagcgtgatgaaagagttaatagctaaaggaaaaataaaacattggggtttatcaaatgcaccattagattatttaaaaagagcacatgcggtatgtccagtaacttgtattgaaaatcagtattcaatggtctttagacagcctgaaaaggaagtgtttaaagtttgtgaggagttaaatgtaggatttgttgcttattctccactaggaaacggatttttatcaggtaaatatacgccagcaacaaagtatgctgaaggtgattttagaaataatatgggacgttttaatcctgaagtaatgaaacgtaatcaggccttattagatttagtgcaagaaattgctgaacgtaaaaatgctactagcgcacaaattgttctagcttgggagattaatcaaaaagattggattgttcctattccaggaacaaccaaaatacatcgtttggaagaaaatttaggagcaatggaagttgagttgactgaacaggagatggcggctattaatcaagcattagacaatcttgatattgatgaaacacatttttaagcagagaaaagtacaaaggaatttgtactttttagtgttatacgtttaatcctgaataatgaataatatagaaactatcacggtgtatttagttttgaaaaagtgtattatttggtatatcggcgttattagtctataatagagttgaaagaaagccggtggtaaaatgatgccctatatattgatcttggttattctaacacttttatggttaggcgcattttggaggataaaaagaaagcaaaatataaacttactagctggctttttatttttcatgtttttaagtacctttgctagttttttagtaatgttaggaattaattattcaaatagattagtatatttattagttggtgtaatttttttatttgccttgtttgttttattatttggagtctatatcttaattgcattcttattaataaatagtgttatcattcttcgaaaagagaggttcagtctttcgcatattttgactttgttggtagcagtagggataattttactgattacactatcatcatttttaggtaggattaatccaccattaccaattatggcattgtggagtggcctgatcgtaatgatcttatttcttacttttcatattttcttatttatagaaactttgatattaacaaatctttttcatcctagaaagaatttaaattatatcattgttttaggaagtggactaattaatggaaatgtttctcctttattagcaaagcgtatacaagcggctttaaagtttgctaaaaagcaagaaaagaaaaaaggatttgcaccttatttgttgatgtccggaggacaaggaagtgatgaaacgagagccgaagctctagcaatgaaagagtatgcgattgaacagggttatagtgaagaattaattataacggaagaaaagtctaaaaacactcttgaaaacatgcagttttctaaagcggtcatggaagaaaaaagccatggtgaaaactataaatgcgcttatgccagcagtagttatcatttaatgagggcaggtatttatgcccgccaagttggtctgataatgagcggattaggtggtaagactgctttctattatttagccaatgctgtattaagagaatatattgcctatctagcaatgaataaaaagctttatttggttgttttagggagtatttttatgtttggaactttaatgtacattttgtttagtgcattaattggttaaacaggggtcaaaggagattaaaaggtgaaatatgaatggatagacagttatttattagcgaaggcgggaatttctaaaaatcttcaaacagaatggaattggattagatatgttattgacggtaagatgtgtgtggcagtttgtctagatgaacaagataatccatattatataactttaaaattaagaccagaaaacggaatggatcttcaagaacagcatgaagatataattcctggttactatatgaataaaaaacattggaattcaataaaagtaaatggttcgattagcgatcaattactaaaggatatgttagatgaagcttatgagttggtattgtcgagctttagtaaaaaaagacagttagagatattatctttataatcaaaaggggaattttgatgaaacgatgcattggaatgacgggaatagtttggaaatttaaaggaggattaaaatgactattctagaaaagaagattgctaaaaatattgatattattaaatctggaaatattacaagattaaagagggaagatgataaaaatcatgaatttatatattttcatgatttttttagttgaaatgtattctttttataagcaataataccatttttctgtagtttacttaattcactagataaagcacttctctctactgctaagtagtcagctagttgttgacgattaaaaggaatttcaaaagttaaagaattattttttagtgcttgcgaatttaaataagaaagaattttttcttgagttgttcgtctagttaagtgatgaattttttgagttaaaaggacatttttgtttgagacgattgaaaggagattttgaattattttatgatgaaaagaacatgagtgttggcatgatctaataagatgggagatatctaagaaaagaattgttgttatttctgtagctacgacatttaaatcaatttcttgttgtaaggcacaggcataagattctaaaaagaattcactggctttaatttcgctaataattgttttattaccccaaaaatcaatatgataaatatgtgcttgaccgtcaagaactaatccaatttcatgaataatatcaccttgtctgataattgtttcgtttttttgatatgttttttcatggcttttcaagcagtttaatagtttttcaatttcagcaggatcaattcctttaaataatgaacattgttttaaaatttgtaattttttcataatttgctccttttgttgtaaaaacaacataaatgttataaatactttattatagtatggctgtggagtcaagattaatactctcgattaatgtgattattaaaaatatagagattataaaggagaaattatgatggaaaataaaatgttttgttatcagtgtcaagagacagtaggaaatcagggatgtagtcaagttggtgtttgtggaaagaccccagaaacagcagggctgcaagatttattaattgatgttacgaaaggcttagctgaggtaattaatgaggtacgttgtaaaggtaaagaaatcaataatgtatatgatgatcaagtgagtgaaaatctatttattacaattactaatgccaactttgatgatcaaatgattattgaagctgttagaaaaacacttactttaaaaaaagagctgcttttacagttagatgatcaagctgtactttcaaacagagctctttggatggagatggagatagaagcaattgagaaaagaatgcagatggttggagttttagaaacagcagatgaagatattagaagtttaaaacagctgattacttatggtttaaaaggaatggcagcatataataaacatgctcatgcattagggtttcgaaaagatgagattgatcgttttattgaaactactttggttaagattgaaacttcaacgatgtctttaaatgattatgtagcattaacgatggaaactggaaaatatggtgttcaggtaatggaattattagatcaagctaatactagcacttatggaaatccagaaataacagaagttaatattggagttcgaaataacccgggaattttagtttctggtcatgatcttaaagatttagaaatgctattagaacagactaaagatacgggaatagatgtttatactcatagtgagatgttacctgctcattattatccattttttaaaaaatatccaaattttgttggaaactatggtaatgcctggtggaaacaaagagaagagtttaaggcttttaatggaccggtcttattaacaacaaattgtttagtaccgccacttgctagttatcaagaacgggtttatacaactggagcagttggttttgagggatgtgttcatattgataaagatgaacacggctacaaggatttttcacaaatcattgagcatgctaaaaaatgcttagctcctactcaaattgaaactggtaagattgttggtggttttgctcatcatcaagtacttgcgttggctgaccaaatcgtaacagctgttaaaaatggggatattaaaaagtttgttgtaatggcgggatgtgatgggcgtcatccaacccgtcaatattatactgattttgctcaaagcttaccgacagatagtgttatcttaacagctggttgtgctaaatatcgttataataaactagatttaggaacaatcaatggtattcctcgagtattagatgctggtcaatgtaatgattcttattcactagcgatgattgctttaaaacttaaagaggtatttgcattagaagatattaatgagttaccagttatttataatattgcctggtatgaacaaaaggctgtaattgttttattggcattgttatcattaggagttaaaaatattcatttaggaccaactttaccagcctttttatcacctaatattgttgattttcttgtagataattttcaaatttctggtattcaaagtgttcaagaagatttaaatttattttttcctcagacaaaaaaagaagataagtttcatcgcgatatgctagttggaagtattattggtatggatccacaagcagcacaaattttaagcgatagtggaatggggtgtcttggttgtccggcatcgcaatctgaaactttagctgatgcttgtctagtccatggtttagatgttgaagaaattttaaaacaattaaatcagtaggaggaatttaatgagtgcgtttttagggccagtacattattggttatatagaaaaattcaatatcaagaacaattaaatcaaaagattcttaaaagaatttgtccccagcttaatgagattgttgctcaggaatgtggcacaattcaagatggaagtctagaggaaattattgatcatcaagcaattcatcaatggctttctatggaattgatgatagtagaaaaacgatttgcatttattgttgaacatatagaaaaaagtgattttgaggaagttagggaagtgttgttcgaggctggcaaagaaatttcaatcaatgagaactatcataactgcatagaattattcaaagtaattaataattatcttatcgatggaatgccttgtgataaaggtattaaaataatgagccaagaggaaaatcaaattatttatgaatataatgaaatggttcatcaatatttagattttgaaatatttcaaaaatatcgcaaagcttggcttgatggggtactttcagatagccatatagtattttcaagacttaattataatacttatatgttaaagatggaggaataaaatgacaaacaatataattaaagatttagaagctgatcatcaaaaaatattagcatttgttaatgaattagagcaacgtttaatagaatttatggaagcaaatatttttgattatgaacaaatgaaaagagatattttatttattagagagtttgctgataaagaacatcatcagcgtgaagaaaagattttatttagatatatgatagagtatttaggtaaagttgctgaaaatttggttcgacatggtatgattgttgaacatgatcttgcaagattgtatgttaaacagtgggatgaagcacttcaacgttatcatcgcaatcatttgttaattgataaactaacaataatttcaaatggacatgcttattgtatgttactaagaaggcatattgaaaaagaggatacagtagtttatccgtttgctaaaaaacatttatcagaagaaatctttgctgaaatgatcaaagaaaatcaaaattattaagtataatataagtgaaaagcagctatttttgtaatagttgtttttttattaaaattacttaaattgaggagtgttgcaaatagtgatataattatgttctatagttatgatagggggtagagtgatgataaagaaacataagccatttattgctgcaattttaatatttatgataatgagcattctatcattttttatcttgtacggtgtcattaatgataaggtagcagcagccaaagagaaaattcattattttacagaggctcaagttagtcagctagatcgggtcctgtcttcgtatattcaaactgctgaaacgttgaagctgctaattgtagatagtaatggtaatattaatgattttgatcgagttgcacatcaactatataatgatgataatacatttagaagtattcaattagctccgcagggagatgttcaatatgtttatcctcttgaaggtaatgaaggagcttttggaaatatcttcgaagatccagaacgtgcaacggaagctaaaaaagctcgtgatactggggaaactaccttggctggaccattcgaactctatcaatcaggaaagggaattgttgttcgacaaccaatttatttagaagaaaatggagaaaataatttttggggatttgcaattgttgttttaaatgtaccagaaatttttgattcagtacatctagattcatttaaaaatatgggatatgaatatcagttatggcgtattgatccagataataataaaaaacagattattttgaaatccgatcatgaactattagatgacacaataaatttaagttttgaagttccaggaaatacttggactttgagtgtttcaccaattaacggatgggttcgaagtagtgatttgatgccagttattatattagctatctgtttgtcattgttgataccgttattagtttatacattactaaaaattaacgaacagcgccgaagaatgatcgatatttctaatcgtgattatctaacaacgctttataatggtcggaaaatgaattttgttttaaacgacttaattgctcgtcaaacttcgtttatttttgtttatttagatgtagataaatttaaagttgtaaatgacacatatggtcatttagcaggagatgtgttattaaaagaaatagctttacggatcatgaggtacttatcacgagaggattatgcttttcgagtaggtggtgacgaatttgtcatcattattaaaaataattcttccaccaagaagaccctccaaataattgctgagcaaataacagaaaagataaatttagatggctttgaatattatccggaagttagcatgggatatgctgtttatcctaatgatggtaaaagtttagaagaggttattaaatgtgctgatagtcggatgtatgaaatcaaaaaacataagaatatataatataaaacacagtgattgttaaatgatatgattcctcataagtagtttttggtcatttgccctatctacttgatagagagaatatcaaaaatagatcactgtgttttttgttataaattagaatattgttgtggatcaatcaaactagcagctgcttgatcgcaaataacagtaaagttagggtgaagctttaaaattgttgccggcacatcttgattaacaggctcatctaagaagcgtttaaaaatttctgctttttctttaccattaacgatcatgactagatgtttgactcgcattagacttttaggacccattgtcaaagtatgaggttgtcgaggacggtctccataatctggattaacggcctgctttttcttgaaatcaatacagtaagtataactgtcaaaaggtgtacaacgaggacaattaccacaaaaatgtccatcatatccaagaccaatcaccattacatcaattcctccagcatttctaattttattatcatagtcttgccagtcatttgaagtcataatgtgaatacgctcatcaggaatattagcggctttaaaaaataattcttgcatatccttccagtttggtccataaggttcatcaatatatgggttttcatcaaaaagataatactcaatatctttaaatttagcctgattttttacataaggaatcatcatgtcatacatcgttttaggagaacgaccggaagtaagtgaaatattgacacgtttatcttgcatcatggcacctaatagaataaacattgcactttcactcattttttgttcattttcttcaattattagtttcattttagtaagctccttttcaatttttgattaaaatgatgtaaataaaaaaatgtaatatataatttaagtatactgtatttttttagatacacaagtttatcggttgtaaatgatcaagaaaagttaactatatataaatcaagtaatttttgataattagctaaaatattttttagttctttgaaaagtgaattttggttacgctgaaaactactactgcatgcagctttttaaaaatattaagttcagcatttttaaatgagcagtttttatcaaactatatgttttcagacaataatttatagattactcttgtaagttttcgtactgagtggtcctgggcacatctgtggaatttaccttacagtcgttttagtttataatatttattgaaagtgagattgtacttgcagactggcagaatgtattgatatagctttttcttaatagcgcgaaccacgttttgactgtgctgttcgagaaattgactgataagtaccggggtctatacctacaaattctatgactttgacagtagagctgaagttatggatatcgctagtctcatctaaatttgtcaacatcgatatcagtgtaaaatatggaaaacacatcctttctttatataaggtaatgaaatgtgatcaaaccacaaacagagtatcaaagacctagtgcgaaatacaagttcaaaaacttatctaactgattacaattaagatacaaagatgtggtattaaccttttccaggtagtcgggctacagaaggcaaaaacaaaagtacctattcacaattcgattctaaatgaaatctaatgaaaggaagaggtgtatacaattgacggttaaataagttaattacaatataccagaagtcaaaatatgaaaacattatatatgatgcgtcatggacaaacgttatttaatcaaaaaaggttaatgcaggggtggtgtgattcacctttgacagaactgggaaaaagacaagcaagatgtgtaaaagagtatttggagaataatgagattgtttttgatggtgcttatgcatcatcttcagaaagagcttgtgatactctagaaattgtaactagcctcccatatcagcggcttaaaggtttaaaagaatggaattttggtatttatgaaggagaaagcgatgatcttgatcccccttttccatttggcaatttctttaagaaatttggtggtgaaagtgaaaatgaagtaagtgaacgtgtttcaacaactgttttagaacttatgaaaaatactgatcaagaaacagtgttaatagtctcacacggtctttcttgctattgttttgcgaaaagatgggaacaaaatcagcaagtatcgctacctaatgatatgcccaattgtgttgttttaaagtatcaatttaatgatgagcagttttcattagttgaagtcattgatgtaactagtgaattaaagtaaaaaagtctagatatagaaattaatctatatttagactttttaatcaccaaatgagatacctagtaacttagcgtctttaacttttgctcctacagcatcaacatattttagtttaccagcactttcaactaagggaatagcagtaactccattattttttaagataactaatttgccataatctccgcccataactaaacgggctccagctaccccaaattgagttgagatcattcgatcgtatggacatggctgtcctccgcgctgggcatgaccaatacatgacacacgaatttcgctatcaatatatttttctaattctgctgcaatctcgtaaacaactgattgaccattgcgggctttaactttagctttatactctttttttgatagtgttgcttcttctttggataaagcgccttccgcacaagcgataatactgaattttttcccatttttttctctagttttaatagccttagctacttctttaatatcgtaaggaatttctggtaacaaaattacatcagcgcctgaagcaattcctgctgacaaacaaatatggccaactttatgtcccattacttcaattacaaaaacacggttgtggctggcagcggtagtatgaatttgatcaaggtatgcggttgcaatatcaattgcagactgatagccaaaagtataatcagttccccatgtatcattatcgattgttttaggtagcgctataacattcaatccttcttgagagagcatgttagctgattttatagaaccatttccgcctagcacaacaagacaatctaattttaattttgcatatgtgtttttcattgcagctactttgtcaaagtcatcttcaattactcgcatttttttaaaaggacaacgtgatgttcctaaaattgtcccaccaatattaattattccagaaaaatccttgggcttcataattttataatcttcatacattaaccctttatagccttgaagaaagccaataatttctatatcgtttacatttcgatataaagtttttgctagaccacgcattgttacatttagtgcttggcaatcaccaccacttgttaaaatacctacccgcatataatcactcctttattattatttatattgccaattatttgaaaaaatattcctgactattcaattctggctctttattttttactcgtttgtaagtaccatcttctaataagcggcatgctttaacattatctttcaacattgcattaaacattgtaataattcgttttcttaatttttcatctaaaattggggcagcgacttcaacacgacgtgataaatttcttgtcattaaatcagcagaagaaatgtatactttttgagcactgcctttaccaaagatgtaaatacgtgaatgttccaagtacctaccaacaatagaaattattctaatattatcagttaatccctcaacaccaggtaaaatacaacatataccacgaacaatcatatcaattttaacccctgcctggcttgcttcgattagcttatcgatcatttctttactagtgacggaattgcatttaaatccaatataagcttctttacccgctttggctaaagcaatttgattatcaatatgttcaaatatttttgtaatcatacagttaggagcaaccattaaaagattaacttcattttctgtttcgccaagacatagatgattaaaaatgctgttgatttcttccccaatttcgtagttagatgtcattagtgataaatcagtataaagctttgatgtattttcattatagtttcctgttcccacctggctaatataatgaacaccctgattatttttataagttattaaacataattttgagtgaactttaagtccatctaaaccatagataacacggcatccagattcttcaagtcgttttgaccagtcaatgttattttcttcatcaaaacgtgctcgtaattcaactaaaacaacaacttctttaccgttttcagcagcttcaatcaatgatttaataatcttagatttctttgcaacacgatataaagtcattttaatactggcaacatttgtatctcgactagcctcatctaataaacggagaaatggtgacatcgactcatatggatatgataataaaatatctttttttaaaatttgtttgatcattggaacagtattttcaactaaaggactgtttttagcttctaattttttatagaacatttctgggtgaatgtagcgtaaatgatcacgtaactcactagtgaatttcaaatctaatggagcattacactcgaaaacctgatgttttttgaggttcaagaagttcattaacatcaagatttctaactcttctaagcctggtgatacttccaaacgaataggacataattttctacgttgtttaattaatgtttccatcatttctcgatagtcttcatgaccttctaaagagtgatcatcttcatcaatatcagcacttcttgtaactctgatgaaacctttattttttattgtatatttagagaagatattagaaataaaatgcaggatgatatcttcaatcaaaataaacttcccttgcatactaggaatcgcaatcattcgttcatccatagcatttgcacaagaaacgattcccatctttctttttcccttctttgattctaactgaacaacaacataaacttcacggttatttaaaaaagggaatggttgacgttttgaaataacctggggagagattaatggaagaatttctcgttcaaaataactttcaaaatatttacgatcttctttgttctttaaatcacggtattttacgattccccatccatgagtttttaattcatccataatactttgataaatacgatctttctttttatttaaataagtaattcttcgtaaacatgcctttagctgttcttcaccagtcattccagttttattgtctttagaactaggatagaatagcatttgatcatataatgatccaattctaaccataaaaaattcatcaagatttgattgaaaaatagaaataaaacttaacttttcacctaaagggactttattatctttagcctgcattaatactcgatcattaaatttaagccaagataattcacgattttctttacatttattcattgaaatggcgcctcctattttgtttctaaaaataacataatatttattaaaaaaattatcaagtaaagtcggattacttacaaaactcttacgcaaatttaacgtttctttaatattagtatagcacttttgattttagtattcatcaaaaccataaatatgtaaaatgatttaaatcattcaaaagaaaaaggtgttgtcaaaacacctaaaaatattacgattctatttagatttattatttagtaattgctgatagatcatttcatcgtcctctttgaaaacgttaaaaataactttttcaatctgacttcctttaagaaatgtggatactgtattgattgcaatttgagctgcttcttttttaggaaagttaaatactcctgtagagatacaacaaaaagcaatactttttaatccataagcctcagctttttttaaacaattacgataacattcagctaataaaaagcgcttttcatctgttagtacattatgaacgataggaccaactgtatggacgatataacgacaaggaagattataagcattagttatttttgcttttccggtgggctcaagataacgctgtttagacatgatttggtgacattcatttcttaattgaactcctgcaaaggtatggatagcattgtcgatacaattatgtccagggataaagcatccttccatttgattattggcagcatttacaatggcatcaacttttagttgggtgatatcaccacgccagatattcattgattttttgaaattgcttgagtcaatgattccttttcgtttaatttcattttttaacattttgttttgaatcataatgaatttgtcagtagctgtttttgcttcacgaatatttactaatgagcgataaagggaaaatagttgtgcttgttctgtaggaagttcaatttcaagtttattttcttgaattaaatagttaattaaaaattgtaatcgggttatttgattcatagcaatttctccaaagacgataagacattatgaatgttatcgttgatcatgatagtctgtttttttaattccgaaggtaaatcaataatatcttgattgatgcaggcataaatagctttaggattctctatagttaattgccaaaatggatatttgataattccaggggtattatagccaactcctaattctaaataaacgattttggaataatgatatttatttaaaaagtgataataacgttcttgggcatgataccagccggaatcttgaacaaatgttttatcacagcgaagattcattgtcattggagcattacatattggacagtacggaattagtgaactgggaattttcaaatcatgctgttgtttgatcattgtaacaactgtctcgtaattatcataagttttttgatggcatggttttgaacattgccaaagtccgtaatctccttgagtataaaataatttttctttaataaaaccagctatttgaaactgatgatcaacatttgttgtaatgacgaaataatctttattaatgagtaggtttaataattttttataagtatctttaggggcttccaaatagcggttataataaatatgacgactccaataagcccagtatttctctaaactaggataggggtaaaagcctgccgaatacatatcttgtaaatgatattttgtaatgaaatcattaaaatattttttaaaacggttccctgagtatgacagaccggcggcgctagaaagtccagctccagctccaattaagattgcatcacattttttgattgcttgactcaattttaaaatatcaagtgattctctttgaaacattataacactcccttctcatcgttattatccttcaatggttgctatttgtgaagtacgcacataaaagtggcttggtttcttttatgtaactaacttgactttcataagtatagtttataaaatatacttagttactataagaaactataaggagtacacatatgaaagaatttccaaaatgtccagttgaaactacattattattaataagtgataaatggaaggttttgattattagggatctgctaccagggaaaaaaagatttggtgagttaaaaaaatcaatcggaacgatttctcaaaaagtattaacttcaaaccttcgggcaatggaggagagtggattgattagtcgtaaagtttatcccgaagttcctcctaaagtcgaatattcgctaactgagttaggttatagtttaaaaccaatcttggatgctatgtatagctggggtgaagattttaagaaaaatcatcaatcaatataataatggatagagtctcagtgttaatattttttggatggctgaatgatcttaaagggggttcagtaaaaaatagaaattgataaaaatacgactcataaagatataaagtgtcaaatttctagtttcttaacaagtataatagtgcatgataataacttatgactagagagttagaggggaaaattatggataatgaagatttagtaagagaatatagcaataatcttacaacatatgaacaatttacaaatttgatggaaacatatatatgtaatttgttgaatcgtgaacaaatatcgtttcattcaatcactagtagaacaaagagtattgagagtttatctaaaaagatagagttaaaaaacaagtatcaaaaattagatgaaataacagatttatcaggtattagggtaattacatattatacggatactgttgatcaaatatcgaaattaattgaaaatgagtttattattgatcgtgataattctattgataaaagaaagagtctggatccaaaacgttttgggtatcgttcgttgcattatgtggttcaaattgatcctaagtatgttaaagcacaggaatatcttaagtatcataatttaaaattagaaattcaaattagctcaattctgcaatacacatgggctgagattgaacatgatttaggttataaatctcaagaagagattccctatgatattaaaaggagtttttcacggttagctggattgttagaattggcagatgaggaatttttaagaattaaaaatgagatctttgcatatcaaaatcatttgctgctttcttatttaagtgctgatattgataaagaatcattagctgtatttaaagtcaaaagtcctgaatataatgaattgacagaatttttaattaaagaaatgaaagctaagaaggttagtcagggtaattttgagaatatcattaggatgtttgagtatttgaatataagtaaacttcaggaggtagatcaaaaattaaagcaatatcaacagctgataatggaacacattgatgttctttatcgtgatgcaacaaggactaaaacaaatataatttctggtgatatgccattgttatgtttatgctattttattttagtagtagagaaaggtgaagtggagtttgagaagttcacagaacagtttatttctagtgttaattttaaaaatcgattaatagaattaaaaagaatattgaaagattataaattagaagctgctgattaaattaacagctatttaaactagagttagctctagtttttttataatgtttaaagtatttataataatggatataaatgtaattgtgatcagtcttacgagtttgctaggggctttttataagttatttagaacttacaagatattataatgataacgcttgctttttctgaggaaaaagatgtttataataatatttatggtataattatgatgttagtattattaattgtttcgtttatattgggctatagtttaggatttgaggaggaataataaaatgaaaaactggtggcaaaagagtgttgtgtatgaaatatatgtgcggagttttaaagataccaatcatgatgggatcggtgatattaatgggattactgagcagttagattatttagcaacattgggagttgatgtgttgtggatcacgccaatttatgaatcgccaaatgatgataatggatatgatatctcagactactatgagataatgcaatgttttggaaatatgactgattttgagaatcttttaacgcaagctcataagcgaaatattaagatagttatggatcttgttgttaatcatacctctgatgaacatagatggtttatcgaaagtaagaaaagtaaagataatccatatcgtgattattatatttggaaagatggtaaagaagacggcagtgtaccaaataattggacaagttgttttctaggttcagcttggcagtatgatgagacaacgaaacagtattatttacatttattttctaaaaaacaaccggatttaaattgggataatactgatgttagaaatgaaattcaaaaaatgattgcctggtggcttgataaaggaattgatggatttagaatggatgtcattaatttgatttctaaagatcaagataatatttatcaagatagtccaataaaggggcatagtgtcagtgctaatggacctcgtgtccatgaatatattcgtgagttaacagataacgttttttcaaaatatgatgtgatgactgttggagaagctccagcagtgacaacaaaagaagctattcaatatgcaagtaatgatggaaaagaaatgagtatggttttccaatttgaattaatggatgttgatggtggtgaaaaacaaaaatggagtgatgaaagatttaaattaacggatgtaaaagcaattttaagaaaatggcaaattgatatgcatggacgagcatggaattcgttattttggaataatcatgatcaaccacgagtagttagtcgttttggagatacaagttctaaagaaacttgggaaaaatcagcaaaaatgcttgctactgcccaatattttttacaagggactccttatatttatcaaggtgaagaacttggaatgactaatgttgagtttaagaatattggtgagcttagagatattgaaagtataaattcttatcatcagtatgttgaagtggaaaaaatgtttacccctgaagagatgcttcgatttattaataaatcaagtcgtgatcatgcacgtactccaatgcaatggaatgatctagaaaatgcaggattctctgatgctgaaccatggatcaaagttaatcaaaattataaatggcttaatgcacaagcacaaataactgatgaaaactcaatttttaattactataaaaaaatgatctcaattttaaaggaaaatgaagttgttcagtttggtgattatcaagaatattatgaggatagtaatgaagtctatgtttataaacgggagtatgacggaaaaaaattatttgtcttatctaattttacagctaaagaggttacctatgataaaactttatttgaagctgaagcaaaggtgttactaggaaattataatgatttgataagagggaaattacgggcttatgaagcggttgtactagttgtttaaagttagtattagggatgatcttgaatgatcaggaggtaagaaaatgcctaaaaaatattttaagattggttgcactgtaattatagtaactttaataggattatttttaaaaaataatgctccggctaataattataaaaatcccgatactttgaatatacaagataaacaaagtatgatgatggcagataaggctgttgaaaaaatagctaggggaacatccgggaagtttgaaactttatatttaggggctgatggtcaatttcaatggaatattttaaatccggaagaaactagcttttttgatgaagatggaaaagctattaaatccattttattaatttcaacaaagcttcaaacctcaacaccatttgatcaggaaagtaatcgctatgaaactagtactttacgacaagcagagattgcgttagcatctcaaactttatcaccaaaagaagcggaagtaatatttaatactactcaaccaggtggtgacgttgttactgttactagttattcatttatagaatcacagttatttggtgataaattttttgccccaacagcaaaaataatgaattcaaatagttgtggacttgaagatcgtcattatcgtcaggaggggaattattactggttgtcagcagctgctaaagatgatcctaaattagcgggatatatctctaaatgtggagtttttgcacaattagatattactgtcgagcatcttagtgcaagagctactgctaatcttgatcctcatgcagttttattttttgctgcagcccaaggtggtaaagtcagtggagtagtcgggagcaaagcaatgcaggacgtggaacatcaagaattacttagtgattatcgtttaacattaaaagatgcttcacaaaccttagttgtgagcgatcaggttaaagaaaataataaaataagttttaattataatgcccaaggcgatggggatttactcagtgcagttataattgataaaacacaaaatgagattgtatcttatggtcagttagctgatattagtgttactaaaatgggtgttgctttaattgagttgccaaaaaaatatgatcatgataactatcagataaaagtgtttagtgagcaatataacggggactacaaaacggattatgccagtgaattagttgatttgaagattgaataaaataaaaagagctggatttaactgtaccgacctcctaaccgttagaatttgatatgtatctaaaattcagggcacatatcatttttgatctaactttctgaggtcacatcaaacgatttgttaaatctagttcttttttattaaatacttttgctgcgttcattggctttatgaactttacaaggattgccataagcaattgtatcagcagggatatcttttgtaacaacactacctgctccaattacggtattatcaccaattgtaactcccggtagaataattgttcccccgccaatccaaacatttttaccaataataactggggctgtttgtgttttacaaaaattgaatgtttcattttcactgatagtaaaacgatcaagataatgagtaggatgataagcggtatatatttgtacatttggagcaattaaaacattatcaccaataataattttattatcatcgagaaatgtacaattcatattaacttcgcagttattcccaaaatatatattacagccataatcaacatgaaaaggtggggtaatccataattggtttccaactttacctaataattcattaagaagctcactttttcttttagtatcgctagaattggttagattataatctcgggctagatctttggctcgatgccatagagcaagtaattcggcatcgccacaatcatataattccccagctaacattttttctttttcagtcatttaagataataactttaatagatcaagtggctgctcaaacacgtgatctggtttatcaatacctttagcggaaacacttccccattttgcataaccaaagtcgataccagcgtttttagatgcgagataatcagaatgagcatcaccgatataaataacatcttcaggttgcaaagataatcgctttaaacattctaataacggttcgggatcgggtttatgcttgactgtatcgttagctaaaacagcagttttcatatatttatctaaaccttttgcaacaaaatcaatttgatactgtgctgttgtttttgctgaagcaactgcttgaatgatgcttccgtcaaatgcttcaaaaatttcttcaaaccctgggtataaagaagcgccttcttcatattcattgacatatttaacccatctagcgtaagccttttctttatcagctacttgtaactcttccattactttcatacctggatagggtaaaaattttaagacttgttcaaatgtccaatcttcaccagtttcttctttaataatcttaatcaagggatacatattcatatttattgtatttaatactgttccgtcaaggtcataaataattgctttatattttttcattactttcctccactaattgttttaatattttttcaattcctaaataatttaacccatggaataagttatctaaatattgtttataaactttaatatcataaataaattgtgagtgtagataagtataaatagtttcattaattaaatgccaatccaagtcccaatcaagttcaagagaaaggtcaacatgctcagggtctaaagacgttaaaacaattattaatagataagcaataatgttttgaaagtcttttggcttgttacatgtcctaactgcttgatttaaggaaatatcgtgataaggaataagtcctatttcaccagcaattccatatttgccatgaactaattgtccattatacatatatgaactaccaattccctttttgtttaggtgcaaataaattgaactatttttatgatgatgataacaagtacctaattgcatcgctttgacatcgttttcaactagaataggaatattgatactcttttctaactctgtgatccaagtgtgggtttcaaagtggttattgtggtcggttaaatattcattatctctaacgattccttcaactgcaataacgatacattgacaattgaatttggtgagaagcactttaattagggtaattaattgttgttcatcctcaaattccagaatatcggttgttagtatttttttgtaagaatgaatttgataagttattttagggttttgaatataaagacagattatattaaaatgcttttcaactaatgcaaagcgggttgggcaacgtccaccggttgaatgatcgttacctgtttctttaacaatatcgtgttgttgcaaaaggcgaatcatatttcttacactaggctgtgataattgagtatcattgctcaattcgctcattgtggcactgtctctactaaataatgattgtaataatagatgtaagtgatgtttttttacatctttaagaatttttttggtcatgtgtgcctcctacttttattatactttaataaaagttatttacaagctaataataaaaaataaatatatttttaaaaatggaaagattttatctgctggtttatattttatggaaatttatgctagaattaaagataataagttaaactattaataatatggggagaaaaaaatgaaaggatttaaacgaaataatcaattattatctttgtgcggtttgaactgtggtttgtgtccgatgcatattgatggttactgtccaggatgtggtggtggagcaggaaatcaaagttgtaggattgctcgttgtagtttggaacatgataatctcacatattgttatgaatgttcatcatatccttgtgataaatacatgaaatttgctaaatatgattcatttattacacatcaacattatcatcaagatttaatgaaagctaaagatggtggtatagacacatataatcaagagcagcttgaaaagatagatattttaaaaatatttttagaaaaatataatgatggacgaaaaaagagtttttattgtcttgctgtaaatcttttagagttagaagaacttaaaagtctaattaaacagatagaaactaattcaaagctgtcagctctaacaaaaaaagagcaagctaaatatgtatttgatttatttcaagatttagccaaacaacatagcttaatcttgaaattaaataagaagagtaaaaaataatttacccgtaagattagcaagagtaactaatttacgggtatttttattgtacaattgaagcatcatattgaattgtttgtaataaagctttacaagtattaataaattcatccttattcatgcctttaacaattgcttcactagctagtaactctagctcatcaagtaatttttcttgatgttcatgagaattatcaatcgttggttgaactttagcaccatgacggcgatcaatacaaatatagccttcttgttttagcagcccataagctttattaacggtcatattatttacttgaagatcttgagctaaagtcctaacggttggtaatgactcgccgtatttaaattgaccgttagcaatacctttaacaatttcattacgtagttgcaaataaattggaatttcacttgtatagtctagattaataatcattggctaagcacctcctgaatttcttgatagatgagtttagtattttgaatatcatcatcattaacgatataggttatatcatcagtatacaaaattatatagcaaggatgcaaacttgccatgtatactttacacttaccataacggtcaaaagtataatttcccttaccataaacaaaagtatcggttccattagttctaattcctttacctaaatcatcggctaattctgctttattaactttttgaagatcaattgaaacatcgtagaaaggactatcaacaactactgcttgatcggttaaagaaagattgacaagattattagttatatctaaataatacggatatccaaataaccatagcaataaagcaataacaaatgtccaaataccaataataaaaattcgataagccggttttgcagtattaaatgtcatctgtgttccatttggcgctgaaataagtgtacgtggatcagctttattataatacgttggaccaaaccaaccgattttccagcaatcatcattactgatagtatattcacattcgttgtaatgagcgagaatctttgcctttttctctcgataatggttagctttaatgacaatgataattacacaaagaatcattattaaggcaactaaaaggagtattacaaaaggtagcttttcaagtaagaaaaattgtaaagctaagttaaaaatactatcaccagtgattaaaaagaaaaaacaatgatgaaaagaatcacgacgtagtaaattcaatgttatatttacttcactgtttttacagaatgttttatttggtaattttttaataaagacaattccaagtactaagaccataaattgtaataccatgtaaagatacatggcattttcagcgtggaaataaatcatattccctaatacagatagatcaattattaaaacgaagaagtaacgtcttaaattaaaagggtgtttttccatataggctgataatgataaatcaattttaattttttctattttttcatctggccaattgcgcaatttttttaaagctaataatttagcacgtgcttttctatacggaacataatagacggaaacgttaaaccatatcacaatcataaaataaagtaatagccatttagttgaaaaaataaataaaggaataaatgttataaatgagataataaatacccataaatgttcttttttaaactgtttctcaatttctttaatttcaacagattcataagcccaatcagggattgtaactaaaaataagcgtccttcattataacggctctctcgtttagaagaaaagtacattactacattaataaaaactaaacataaaattaaaatccacatattactcacctcttatatttgtattatataacataatacaaataatacaaaataaaataataaaatattataacatattttgctgaaaatgattcgcaacaaaaagcagaatcgattcgattctgccaggttgataattattcagctgtttctaaaccttgttttttagcagctttattagaagctgatacaagtggtgcataaactaagagtccaattatggttataacgatctgtgagggcgtaccccgtatatcaccagtagatagataaccagaaagtaagggggagttacccatgggataacaatataagtatgtcctactaagccaactgcagttgcaaaatatgctattaaagttgaaacaaatagaaacaatacagaaaggaacagtataaatagggttgaaaacgacaggaagtccaaacataattggttcactgatattgaagatacttgagacctcacccaaacgggcaatcactttttcttgaaaagataaatatggtaacaactaagattaataaaatcattaagaaaaatgaaacttttgtaagtcagtataatgatgattttaaagatgcagttcgtttcagtgttattgattatggcgcaacagtaggaacagctaaagagatggaaacaaaattttctgaaacaattagggttgcaagtcaaggttataagttagaggcttatatgcatggaccatatttggaagtcaatccagaacatcgaattttctttatcgaaacgccaagtccaagattatctaaagcaaaactattaaaagcctatgaatcacagtatacggagcacgtgtttgctattacgaaagcacaatcaataagaccttagcattagatattgctttagatgagtatcaggctgcatatttactaattattcttttccaagtaatgacgtggtgtattgctaaaagtaaagaaattgatttgacgaaatggatttatacagatttttctcaagcggtcaagagtaaaacggctgtttaagattatgtctagaaaggcttgtcaaaaatatttgacaacattcctaatatctttggtagcattattttgatggtttatttatactattaattataggaggaaagtagatgttaggcgaaaaattaatgcgattaagaaaaaaacagggctatagtcaacaagaggttgcagataagttatcagtgagtagacaaactatttctaactgggaatgtgatcaagccttacccgcagttgataaagccatggaattggcacagttatataatataagtttagatgatttaatggaaaatgagattgaaatagttagtaataataaaactaaagacctacatcttttacaatatttgatcggaaaaacttgtacgctggagtgcacacgagatgcctatttgttagatatatctacaagtgatggaaaggttctaattgttgatgtcaatgatgattgggttaaagtgcagtatcatcgaacaaaaaaaggttcgtttataaaaaaagaaactgttaccaaactaattgatctatcatgtattagcggctttaaggtcgagggggaattataatgacgactattattgcaattattgctttagttataagtatttgtgcaatatatgagattgaaaaactaaagaaaaatgatgttaaaaatattgaaaaagaaattaaggaaacagatcggattaagaatattttagcaggattaaagcagtgtgattgcgaattgattgtaaaagaaaccatgtttttgattgatgtcccatatagtgtagaaggtaaaatcattgatttagatgatgattgggttttaattgttagtatgggaagaaagacgattagtagaatgattaggataaacatgattaaagatgtaatagaattgactaagtagacaactaaggttgtctttttaattacctgttcaaattgaaaatttgaacatatagacttaagtcagttgagcatacgaagtatgcgaaataaaaaaccacctgctatgcgggtggagcaataaagaagttatacaaagatatcacctttccgatataatggagttgttcaagctgtcattataagaaaggaaaggtgattaagtatggcacaaaaaacaaattcattggcacatacgaagtggatgtgtaaatatcacatcgtcttcacaccaaagtatagacgaaaagtgatatataatcaacttagaaatgatataagagaaataataataagattatgtcaatatagaggggtggaaattatagaggggcatttgatgtcagatcatgtacacatgttggtaatgataccagcaaagttaagtgtatcatcatttatggggtatttgaaaggtaagtcagcattaatgatatttgatcgacatgcaaatttgaaatataaatatggaaatagacatttttggtcagaaggatattatgtgagtacagtaggactaaatgatcaaacagtcgcaaaatatataagggaacaagagggacatgatatagcaatggataaattgagtgtaaaagaatatcaaaatccatttgaagataaagaaatgaagaaagaaaacaaaaaagagagaagaagataacaaaaggagaaaggaggaaataaatccctttgagggatggcgagagtcaaaagcgatagcttgaacgaagagaaagcagcgccttgagacgcgagcaagcaacataggcttatagcctcagagaaaaccacgtcttttaggcgtggtttttattgtaaactaattttaaataattagtttacaatttagtgaatgtttgctatgcttaaaaacgaggtgattcaatgagtgtaaaacaaaatgtaattgctttacttgaagaaaatcgtagtaaggtaatatccggacaagagttagccaaccaattgcatgttagtcgtgcggcaatttggaaagcgataaagacattaaaagaagaggggtataatattgaagcaacgccaaataaaggatatgtattattagaaaatagtgatgttttatcaaaacaaggaattgcatattatttaactgaagaaattgatatcttttcatataaaacaatcgattcaaccaatacacaaatgaagaaattagcaataaatggtggtaaaaatcatagtgtaattgtgtctgaagaacaaagcgccggacgtggtagatttggacgaagtttttattcaccggctcaaaaaggggtttatatgagtgttttattaaaaacaggagattcgctacaaaatgcaactatgattacaattaaaacagcagttgcggttaggcgagcaattgcaaagctatatgatattgaagtagcaattaagtgggttaatgatttgtattatcgtgggaagaaggtttgtggtattttaagtgaggcaattagtgattttgaaagcggaatgatcgaagcaattattattggaattggaattaatgtatcaactgataattttccattagaaatagcttccatagctacttctctaggattacaagaagctaatcgtaatcaatttattgcagaaatcttaaatcagctatttgcaattatcgatgaggattttaaattggttttgaatgaatatcgcatggcttcatgtgtattgcataagcaaataacttttaatcaaaagggggagcagtttaccggtttagttcgtgaaattaatgatttaggtaatttggtcgttagtagcaatggtgcagaaatggtattaaccgcgggtgaagtaagtattataggaggaaaccatggagcagaataagttactaacaacaaagaaaataacctattgtgcaatttttacggctctaattacaatcggagcatttatacagattccggtacctttcatggattattttacattacaatttttctttgttttgctagctggaattttattaggctcaaaattaggagcattggcagtattactgtatgttgtaattggattactaggattaccaatatttgcggccggtggaggtttagcgtatattgttagacctagttttggttatttaattggttttattgcaggagcgtatgttacaggcataatatgtgaaaaaactaatgaaatagcagcaaaaaaatatgttttggcagtattgagtggtcttttggccacttatatgattggacttggctataaatatatcattttgaattactatactggaactccaataacttggaaactagttttgctctcatgttttcctttagatttaccaggtgacttatttttaagttttttagcagtcgggacaggaattagatttgaaaagatttttaaaaagaggagaatacaatgttagagaagctcattgcacaaattatggctggttatgaaattagtaaagcagaagctaagatgctgatagattatgatctagggactttaaagcaaggggctgaactaattagaagaagctattgtggtagtacatttgatctttgttcaattattaatggtaaaagcgggcggtgtagtgagaattgtaaatattgtgctcaatcagtttattatcaaactggaattgatatttatagtttgttgaaaattagtgaaattaaagcaatagccctacataatcaaaagcaaggtgtcgaacgtttttctattgtgacatccggacggaaattaaatgttcaagaatttaataaaattttaaaaatatatcaagaacttaatgatactacaacgatatccttatgtgcttcactaggactattaaactttgaagagttaaaaaaacttaaagaaacaggcgttaaaagatatcataataatttggaaacatcacgtaactactttaataatgtttgtactactcatagttacgagcaaaaaatcaaaacaattaaggctgcaaaattagcaggtttggaggtttgtagtggcggaattgtaggaatgggagaatcatggcttgatcgacttgatctagcttttgaattaaaagacttaggaataaagtcggttccaatcaatgttctaaatccaattagaggaacaccgttagaacatttgaaaccattatcaaaagaagatgttgaaagaatatttgccatttttcgttttattcttcctgatgcaacgattagaatggctggtggtagagggctttttgatgataaaggaataaatgtatttaaaagtggtgctaatggcgctatcactggagatatgcttacaactcagggaataactattgctgaagatcaaagaatcattaagcaattgggatttagggtagccaagccatgattaaaggtttgtttgttactggaacagggacagatgttggaaagacatatgtaagtgcaagaatagttaaagccttgaaatcacagtataaggttggttattataaggcggccttaagtggtgccgttgttgaaaatgatgtactgataccaggtgatttagaagttgttaagcagtatgcaagtctgccaaatgaaagctgtaaagtatcttttgtttatgaagaagcatttgcgcctcatctagctgcaaaaaagactaatacaccagttgatttaaatactataaaagcagatttgacagatttagaaaataagcatgattttgttgttattgaaggaagtggtggtattgtttgtccactgcgcgatgataaattgataatgcttagtgatgtgatgttactggctaactatccgctaataattgtaacatcatcaggcttgggtagtattaatggagcagttttaacggctcaatatgctaaacagttaaatttaaatgtacttggttttattatgaataattttgatagtaacaatctccttcatcaagataatcgaataatgattgaaagattaagtagttataaagttttagggtatttaaacaaaaaagctgataagattgaatggtttgaacaaattatagaaagttaagataaaaaagtgaaatatacctcggtatttaatacttaatatctaataaacgggagatatttcaaattcacttttaattataaataatcggttcctatctactttagcggagttatatcaatatgtagttacagtttttttcatgttaacattattggcgaaatgttaacggattgatatagacgaaaaaagacaaaatatctatgatatagataggagggatgggttatgagcattggtaaaaaactactaagcctaaggcaagaaaaagggatttcacaagaagctttgggccgtgaattaaatgtatcaaggcaaacagtgtctaaatgggaaagtgatttaagtttaccagacatgaaaatgatgataacaataagtcaattttatgaaataagtattacccaattattagatcttgatgatgaaacagaagctgattcaatcaataagatatatgaacaaacatcattagtgttagagaatctacaaaaggaaaataaaaaaaagattattcgtgattggataattattattatttgtactctttgtttatgtgttgcattagcaatactagttaaaaagggaactaatgaggtagttttttatcctaataatagtacaactccaataaccgataacaatataatagattattcaaatacaacatttaaagtgattagttatgactttgataaaatgacaatgagtattaattataaatgcgttttaaataattatacagatataactcaagtaaatatctgtattgttgatgtttttaataatcagagtatttatccaatgactaaagaaaatgcttatacttttgttttaacagaaacaattcctttagtgaattatgctaactttgaaattttggttaaaaatggtgataaaggagaaaaaattaatgcggattcagaaatagaacatcatttagacaacttgttgagtcacttgatttatatctatattccaggtgataaaaattataaattgattagaaataatatgatttataaattagattatagttatttagaaaacgaaaagattgattatagtggtactttatcaaataaagtagagataattattaataaaattaaaaataataattatgaaaaaattggtcaaactaatacaactttagataagcaaaaaaagataaaattatcaaaagacttatctaatggtagtgagataaatgttatcgtaaatataataaccgctgagcaatcatatgaattggttaatattaaccgttatgttcaaactggaggaattagttattctgagtatcctatctatcgttattgagatatttaaaaaaagatcgtaatgatcttttttactattttatttcaatgagttcgtattcacgagttccgattccaattttttcaccatgttctaaacaagatttccagtttgtttcaggtgatacgtcagtaaagtgatcatgatgatgatgaccatgtttatctaacaaactatttgcaatagcaggctgtttattaacagcatcagcacaagccatatctaaagcaacgggatcaaatgaggcaaacattccgacatcagggacgatggcaatatcattttcactatgacaatcacaataaggtgatacatcaataaccaatgaaatatgaaaacatggccgatcttgcacaactgctttagtatattcagcaatcttatagtttaaaatgtcattagcttcatccatgctggcaacgattgcatctttaggacagactccaatacagcgaccgcatccaacacatttatcatgatcgatagaggctttgtgatcagtaatacttgtcccgttatgagcacaaattttaatacattgtccacagccaatgcacttatcttgctcaacgacaggtttgccagcactgtgcatttccattttaccagcacgggaaccacatcccatacctaaatttttcaaagcaccaccaaatccagtcaattcgtgtcctttaaagtgatttaacgaaatgataatatcagcatccataatagcttgaccaatttttgcttctttaacatattctccattgattggaacgatttcttcatctgttccttttaaaccatcagcaatgattgtgtgaactccggtttggaaaggattgtagccattagaataagcactgtctaaatgatctagtgcattttttcttcctcccacatatagagtattacaatcagttacgaaagcttttccacccaattcttttacatagtcagcaacagctttagcgtaatttgggcgtaaaaaagctaaattaccgggttctccgaaatgtactttgatagcagtgtatttgtttttaaagtcaatttcttcaaaacctgctttcttcattaaaaacttcagtttttcaggaagattcattcttcctgtatgcatatcacaataataaacttttgctttttccataattacctccatgatattatgtccttgtataatttaattttagcactatttattgtaggctaaaagctaaatcaattatatcttacatcttaaagtatgctttaacgcaatataaatagcaaataattacaacaaaaaaagagcatctcaaatataaatcgagatgttcctttaaataaattattaattattttcctcagcagtatcattagtcaaattgaatttatctaataagtagaaagttagtgaaagaatcatagcaacaatacaagctagcaccattccagttaattcgacaccaccaaagcttagcgtaatactgcttaatcctgtaacaaaaacaactgaagttaagataaggtttttattagttgcgtaatcaactttttgatcaactaaaattcttaatccactagtaccaatcattccatatagtaagaaactgattccaccaataaccggtccaggaatagtttgaattagtgctgataagggtcctacgaatgaacaaataatagaaagaacagctgcacctgcaattacttgaacactatatacaccggtgatagccataaccccaatattttcaccatatgtagttgttggaacagaaccgataaatcctgaaatcatagttgaaaaattatcaccaaataaagaacgatgtaatccagggtcttctaacaggtttttaccgattatttttcctgtaacaatttgatgaccgatatgttctgaagtaattacaagaagaactggtaagatcatcaagatagcgttaatatcaaattttggagttgagaaattaggtattgcaaatagtggagcatttgctacagttgtaaaatctactaatccaaaacaaattgctgcaatatatccacagataattgcaataagaattggaatgacacttaaaaattttctaaaacaaatatttccaaaaattgcaactcctagagtaattaaaaatacccaaacattggccatctgaatattatcaccaatcaagcctgcattatttgcagcggtagcacttaattctaatccaattaatgcaactactggtcccattgcagctggtggtaaaacaatatcgatccattttgtcccacattttttaataattaaggctaataaacagccgcaaaatccgactgctacgaatccccccaaagcataagggtagccaaatttagaaatgacaatatttgctggagcaataaaagcgaagctagaacctagataggcaggggctttcccttttgtaataacaataaataataacgttccaataccgttcatgaataagacgatagctggatttatcccaaataagaaaggtactaaaacactggcaccaaacattgcaaacatatgttgtaatgataatggaatcagtaattttcctgggactttatcctcaacttgaataatccgtttattagacatacatgtcctcctttttaaccttaaatattatgtcattatttagtgatactgtctataaaaatcttcttattttagtttaaaaaatttaattgttcaaatatttgattatttcctttatcgcttggttgaacaatatgttaaaatgatggtgcaggaggtaaaactatgcaattagaagaactggtaaatcagtattatgatgatttaaatgaaaatgatttaatgatttggaaatatatattagcccataaaaaagagtgctgtgaaatatctattgatgaattatctaaacgttgtaacatatcacgggcaacaatttcaagatttagccaaaagatatcttttgagggatttcgtgaatttaagatgcgtttaaaattagaatgtcagcaggttcaagtaaagaatgatggaatgcttgatgaaatttgtaataattatctaaaaagtatggaactaactaaagatagcgatcttgatgacctctttgaacatatacatcacgcacgtaggctctttgtctttggaactggtgagacacaaaatacagtagccgaaatgattaaaagagtttttcttcaaactaaagtatttttcgtcaccttatatggtaaaagtgaattaaagatgactattaatggtttaggagaacaggatgtaatgatttttatttctgtatctggtgaaaatgaaatggcaattgaggcaatgaaaacattgaaaaataaaggtacttatattgtttctatcactaaactaaataataatacactagcgcggcttgctgataaaagtttgtatgtaattacagatcaatacaaaagatttaataatcgtacctatgaaacgacttcagcatattttaatacagtagaaattttatttcttaaatatctagattatctggataatttagatgagtaaaatatttctgcacaattttaagtttgagaacccttgaagtttaattttaagggttttttattaatatttactgtacttatgcacaaatcttgtgcaaaggatataaatgtgaacctcttctttaaatacgcttaagatgttgaatcaaaaattatttatattacaataaaggtacattaagatcttagtgcagcaaaaaataaattaactctcttgggggtcatggaatataaatatatatttagcgcgaatgttatttatattggatgcatagagggtttctaaaacttattaatccatgaaacagaggagaaaaagaaaatggaaaagaaatattcagttgttattgctggtggtggaagtactttcacacctgggatttgtttattattgttagatcatatggatcgttttccaattagaaaaattaaattttatgataattttgcggaacgtcaagaaaccatcgctaaagcctgtgaaatttatttaaaagaaaatgcaccagaagttgagttcgcttatactactgatccagaagaagcttttactgatgttgacttcgttatgtgtcatattcgtgttggattatatgcaatgcgtgaaaaagatgaaaagattccaatgaaatataatgttgttggtcaagaaacttgtggtcctggtggaattgcttatggcatgcgttctattggcggggttattgaaattctggattacatggaaaaatattctccaaatgcctggatgttaaattattctaatccagctgccatcgtagctgaagcaacaagaagattacgtcctgattctaagatcttaaatatctgtgacatgccaatcgatcttgaagaaaagatggctaacatggtagggttaaagtcacgtaaagagatgtctgttggatattatggattaaaccactttggatggtggcataaaattgaagataaagacggtaatgacttaatgccggaaatcaagaagcatatggcagctaatggttttgcagatgcactgtcaggaacgaatcagcacgtggaacaaagctggattgaaacattcgcaaaagcaaaagatgtttatgcattagatccagaaacaatcccaaacacatatttaaaatattatttatatcctgattatgtagtagaacatactaatccggaacatacacgggcaaatgaagtaatggagcatcgagaaaagaatatctttacagcttgtagaaagatcattgaaaaaggaacagctgtagacggagggtttgaaccagatgcgcatgctgaatatattgttgacttagcttgtgcaattgctaaaaacactaaagaaaaaatgttattgatcgtaccgaatgaaggagcagtagaaaactttgaccgtacggcaatggtagagattccatgtatcgtaggaagcagcggatatgaaagaatctgtcagggatcaattccacaattccaaaagggattaatggaacaacaagtatcagtagagaaattagtagtagatgcatggataacaggaagctatcaaaaattatggcaagcaatcacattatcaaaaacagtaccaagtgcaagagtagcgaaattaatcttagatgatttaattgaagcgaataaagatttctggcctgaattgaaataagatgttaaaactatttaaaaagatactagtgtgttgatactggtatcttttttatcgttcattgaattttaaatagttttttataacgatatctttaaaatcattaaagttcttacatttttttatttctgatattacaattggttcattaaataataatactagagattcatacaatgcatgaaaatgtttgttatctattttattaaaagcaatcataaaaactacattgacaaaatgctggtttccccagtcaattcctttatgactaattaccactcctatactagttttataagcgctcattttcataggatgtggaatggcaatattcataaaagctgtagaacttgctgtttctcttttccatatctcttctttaaagttttcttctacatagcctagattaatcattcgttctgctagttcgttaataacagcggatttactaatatcttcattcattgaataaaaaagtttttcattaaaataaaaattaagattattagtaagaatttgactttttttagtgttctctattctaatgattgcatctaaaatcttatttttctcatagctcattgggaatggtggtaataatacggtaaagtagtttgtagattctaaaacaggaacagtagtgataagaagatcaaaattattccctaggatctcattttcaaatgaaattgatttttgaatagttaattgatctccaaaatccatcataatttttttgtgtaaagtactagtgatatttaaatattcaggacataataggagacaggatacttttgtttcttcttttttttgtctttctatctctgttcctacatgtaaagcaatgaaggctatttcatcctcattgacgttttcatgaaatgataatgtcagctgataagcaataaacgttgagatatcatatatagttgggcatgatattttaatagaatcaagcattggatttttaagaagattgttttttattaatctatttttaaggttttttagatgtagcataaaaggagttataaaattatcggagtcaagattaataaagaaatgttcatcaacattttttatgatatttttggtaatttgaataatttcatctgatactaataaagaaacattttcgttttcattatttatataatttgcattatttttaaagagaatatagatttcaagtatttctgatgaattaaaagagacattaaagacttgttctaaggctaggcatagttctttagctattttttcatcatttttattagtaacttgaattaattcattattgttaataatgtgattaccatggttgattcgactaaccataatagttacatgcaaaataaaattaacacaagaaaaatcgttaagatagtagtgatgctgtttgcaaatatctttgattagggtgcaggcatcatcaagatcataatctgggaaactttcttgtagcaaagttaagttaagaaaatttccgcttacttcttctgacatcacatggctaattagtttacgtttattttgttcagaacctccaacatgaagtttattattttcactagaaaaagtaattttaaaatttgcaaatgaagtattcattttataaatatctttttttaaagtactatagctaatgaataattcctcacataaatcaaaaatatcaatatagtcctgcttttctaaaagcgtcttttttatgatataaatacatctgctttcatagtcctgaggaatatcgtctttatattgaagtagtgagttagcttttactttatcgatgacataaccacgattgctagaagaaatcaagctaggataattcatgtttaattcggcaatatatgatttaattgttcgaatagagagatttaatgcttttgaaagaatatttgctgtaactttttcattatgagtatataaataattgatcaattcttcttgcttccttctcatgctctcatccttccctagttgttgttttctatattataatagttttaatttttatttaaaactagaattttgcacagtgcaaaatacttatttgcactgtgcagaatgttagttgagtagatatgaacaaaatgattaaatataagcgtaaagttcaagaacttgcagacaaataagaaatggaggaaataaaaatggcacaagcacatatttatctttgttgtggaggagggctctcttcaggatttttagctcaaaaagctcgagcagctgcaaaaaaaggtaaaatagatgcaactattgaagcaaagagtgaaagcgaagtcacacaatatttgccaaaaatggatattctttgcattggaccgcattatgaatttaggctgaatgcttttaaagatatggcagccccatataatattcctgtaattgttattcctgaagaaatttattcaatgttagatggaaaagcattacttgaattagcattattagaaatagaagagttttataaataaaatatataacaggagagagaaaaatgaaaggaattatgaattggtttactaataaattagcaccagggatgcaaaaagttttcagtaatccttggattgcagcagtggcgagcgcaatgcagaaaatcttgccgtttattttggtaggatcagttatttcaatttacaatgtatttgtacgttacattccatcactaccggacttgagttttgttaatacatttagctttggaatgatgtcattgatagtagcttttatggttacttattttgggatggtggaactggatcatcctaaatatacaataactgcagggttaacttcagtgactgtatttttaatggccttatgtccaaccatggcaaccttattaaaaaatgcaacaactgggaaaactgaacttacttttacagatattaattttttaggtggatcaggtttatttattgcgattattgtaggattagttgtaatgttgattttccatttatatgcaaagttacatattttggaagatagtgctacaatgccggattttgtttgtgaatggataaataatattgttccaatgacaattatctatttaatatttggagtaactgtatttacaataggttttgatttagtagaatttattaatttaatattccagccgattgttaatttaggacaatctttactgggatttgttgttatttgttttttatacgtattgttatattcagtaggtatttcagcttggtcgttaaatgctattgttaaaccaattttaatggcgggaattgcagccaatgctgagatggcattggctggaggaagtccaatttatattgtgacaacagaaacgatttttacaacggccttaatcgcaatggggggcttaggtggaacattaccattaaattttctaatgttatttaaatgtaaatctaaaaaattaaaaacaatggggaaaatctgtattggaccgtcaatatttaatattaatgagccacttgtttatggggcgccaattgtctttaatccgttactaatgattccaatgtggataaattcaattattggtccattaattatctggtttgtaatgaaagctggtatgctaaatattccagccggagttaataatatttctcgtattcctgcgccgatttgcacctggttaactactgatgatttccgagcgtttatatggtttcttgtactatttattatttatggattgatctggtatccatttttaatgagatatgataatcagcttgttaaagaagaacatgaaaaagaattattaaagaaagaattttgattaacgtaaccaattagtcatatagtgtggaggaataataaatggatgaaaatagtcttttaataccagttgcgatgaaaatcattatgaattcaggcaatgcaagaacaaaagcaaatgaagcattggaggcactcagtatctttgatttttcaaatgcacataagaaaattgtggaggcaagggaggatataaaaaaagcacatcaagaacaaacagaaataattcaaaaagaggctgcaggtgaacattataaaacatgtttattatttacccatgctcaagatactcttatgacaatcatgagtgaggttaatttgacagaaaaaatgataatattatttgaatctttttaccaaatacagggtcataaggagaattaaatatgctactaacagaaaaatacaaaaaacaaatatattatcaatttcctaaagattttttatggggcgtggcaatgagcgcaaaacaggctgagggggctgatgatagagcattgacagttgctgatttgcaaaattatgatccaaatgataaagcaaaggtgaaaggagatttatctaaagcggagattttagaccgtctcaattatccagaaagatataattttcctaaaaaaataggaattgaattttattatcgttataaagaggatttgatattgcttaaggaaatggggattacttgttttcggttttcaataagttgggcaagagtatttccaaatggaatagatggtgaacctagtgagcaaggattaaaatattatgataaaatatttaatttgttaaaagaaatggggatagtgcctattgttacattatatcatgatgatatgccaattgatttagctttaaaatataatggttttttaaatgaaaaagttgtgacagcattcataaaatatgcaactttgattatgcaaagatataaggataaagtaacatattggatacctgttaatcagattaatttaacacgggtaggtctcagttcgttaggaattgtaaaagatacagtgacacaattggaacaaaagaaatatcaagctattcataataaatttgttgtctgtgcaaaaataaaagagattggaagtaaaataaataataactttaaatttgggtgtatgctagctgattttttagtaacaccaatgacttgtaagcctaaggatgttgttttttcaactgaaaaaaatcaaatgacaatgtatttttatgcagatgtacaattaaggggagaatatcctggatatgcaataagttattttagtcataatcatatcgccgtagagataaaagaaaccgatctagtattaataaaagaaaatactttagattttttagcgattagttattataattctaacgttgtcagtcatgaaaagaatactttagctattggcgattcccaattaaatccttatctggagactaatccatggggatggacaattaatcctcttggtctatatgattgttttcttaaatattgggatcgttatcaaaaaccattaatgattgctgaaaatggaattggtcaaattgaaaggttagataatgatacaatacacgacgattatcgaattgattatattagagaacatattattgctttgaataaagcaatcacacgaggtgtcaaggtttttgcttattgtgcctggtcgccaattgatatggtttcttcaggaacaagtgaaatgaaaaaaagatatggatttatttataatgatcaagatgattatggagtaggcagtcataaaagatataaaaaagattcatatatatggtatcaaaatgttattaaaagtaatggtttaaaattagaatagtttatataaaactatggttttttaaagaaactatagttttattttgataattaatttgaaaaagattccattgtaagatgcaattactaaagagacaggaggcgatgatcaatggattttatttttaatatcaatcaaaaaaagaatttattaacaaaaatgaattaaaaccgtgtgaattgatttgtaaaggtttaacaaagatttaaagattatcgctaacagaaatattaactgaagaaagttactaaaacaatgattttgttaaaagtaggatattcaggttatacagaatttaaatatgattgcgttaaatatgtaaatagcttaaataatgctaaagataccgttaataaagagaataataagattgaaaaaatatattgatacaatcgaattgatgcattataccttaatgataaaatgatgagaaagttagccgttttagtaaaataaacaagaagagttcgctgtgttggagaggttaatagcccgataacctgtttgcaattgatttaattgctaataaagaagatctatttttaatgatttcagttactggtaaaagcgatacaataaggtctttaaaaggctatcacagtctgcacaatataataaaccatgaaatatatttttataaatctttcgttttcgttttgaacgtacttccttgctttctaattttgcttgataaatacagaatatcttttcgtctataattatttcatgatgatgtttaaagatttttcatttctcttttggaagtttttgatactcacctctagttttgaaatattcccttttatgaagaattaaatttctaagataagttgcattcattaaaattctacacatatagggattattccatacatcagtatacttacttttattatctatttcattctttaaactaaattcatgtaaagaaagagatggtgttggaatgtttctcttgttaaagtgtgagcaatttgtaaggtaccatagccatctccatcaatttgaaaggtatgttttacaacattagcattaactggattagtcactaattgagcgcttttttcactttacggtaccccaaaggtggtgttgaattattaatttacgtgggaattaatgcagttcaattaaatggcgagggctttattgcacgtattggtcaaggacaattactattggaatttgacatggataagatcaaggctgcgggatattcattagaaacacctgtcttaataacaaatcatactgatttaaaagagataaaaaatactaatgaagcggtggtttctaatgatgtagaattaattaaagttgaattttaaaaaggtgagactatagtttttagtctcatctttttaatgacaacatttattatcgtgttcatgacaagcgtgatgaccatcatcatggtgattacaggctgtgttaggatcgtaatgcaactcaccctttagatagtcgattactgcttcatcactactgccaatgaccccaggaatgatttcgattcctaatgatgtgaggatatttcgtgcacctccgccaattccaccacaaatcaatacatcaatgttaagattttttagaatttctgctaaggctgaatgaccctgaccgttagtactttctatttgactagagataatttcttgattctcaatgtcgtatactttaaactctttactctttccaaaatgttgaaaaatattaccatcttcataagttactgctattttcattctgttatcctccatttttcttttatttttaattgtacaagatgaagtgcaattgactaagtgagctttgtcacaaagagagtagttaccaccttcaatttttaaagaatagccccggacaatgctttgagcaagcttataacgtgcttgttcataaatactctgaacggttgttcgggcaacatccatttgtttagcacattcttgttgtgtgagtccttcaagatccattaatctaattgtttcatattcgtcgattgataggactactgtttttgtagctgacgggtttggaccaaaatatgcatatctaggtaatctgcatacttttctttttcgacatggtcttggcatagcttcaccacctttgttattgacatatgtcaataacattataagctaatattataaaaatagcaataattaaccactatccaatgattctttattaattttataataagtgatatactctaaacgagtaaaggaggttttaacaatgataatacgtaaagcaacaattaaagatttaaaagcaattacagctgttgaagccacttgttttccacctgcagaagcagctagtcggagtaattttaaaaaacgtttgaaaacttatccgaatcatttttggctattggaagatgaaggaaaattgattagttttattaacggaatggtaacaaatgaaacaacgatcaatgatattatgtttgaagatgctagcttacatgatgaagcaggagaatggcaggcaatttttggagtaaatacaattcctgaatatcgtcaacaagggttagctgccaaagtcatgcaggtggtaattgatgatgcccgtatggcaggacgaaaaggatgtattcttacttgcaaggataaattattgcattattatgagaagtttggatttaaaaattgtgggatttctcagtcaatgcatggtggtgctatctggtatgatatgcgtttagagtttgaacatgaatgatttagtaaatcttggtaagtttattagtttgattttacgacataaaccggaactaattggattaaagctagattatcatggatgggcaaaggttgatgagttgttgttaggaattaataatagtggtcgttttattaatcgaacattattagatgagattgtcatgacaaataataaacagcgatatcaatataatgaagatcatacaaaaattcgagctaaccaaggtcattcaatcaaagtagatattgaattaattgaaaagattccaccagaatatctttatcatggaacggcatttaaatatttgaacaagatagagcaagaagggattaaaaaaatgaaacgtttatatgttcatttatcgaaagatattgaaacagcatttaaagtcggaagtagacatggtaaagcaattgttttagttattgatacaaaggcaatgtgtgaagatggctgtaaattttattattcccaaaatggtgtgtggttaactgaggacattgattataaatatgtaatggaagtaattaagtgatggttaataccattgctttttattttctatgttataataataagtatgaggtggaaaacgatgaaagaaaactttttatggggtggtgctttggctgcgagtcagtgcgaaggtgcgtataatctcgatggtaagggattaagtgttagtgatgtaatgcttgcaggaagtaagactaaaaaacgaaaacggactgatgggattgttgctggagaatattatccaagtcatgaagcaattaatttttatcattactataaagatgatttacaatattttaaagaaatgggctttaattgtttgcgagtgtcaattgcttggtcacgcatctatcctaatggtgatgagctagagccgaatgaaaaagggttgcagttttatgatcaattatttgatgagatgttgaaactagatattgaaccagtggtcacattatcgcattatgaaatgccttattatttaagcaggcagtacaatggcttttttgatcggcggtgtgttgattattttgaacgttttgctattacatgtttcaaaagatattctgctaaagtcaaatattggctaacttttaacgagattaatggaatgatcaccaatccttatactggaggtggtgcgattgcaaaaattgataataattatttacaaaccgttttgactgcatgtcatcatatgttcttagcaggagcaaaagcggttaaagcttgtcatgagattattccttctgctcaaattggctgtatgattgccttcttatgtggttatagcgctacatgtaaacccgatgatgtaatgtttaatcataattttatggatgtaaatattttttttaccgatgttcaggtacgagggagatattcaaataaagcattgacatggatgtcacgttatggaattgaattaccagtcatagatggtgatgaaaaaatcttagaacaaggaaaagttgattatattggttttagttattaccagagtattacgatgtcaagtgatattttagataatcttggaagtggcggaaatctttttagtggagctaaaaacccatatattaaagtaagcgaatggggctggccgattgatcctaagggacttagagtttctttgaattacttatatgatcgttatcaaattccgttatttatcgtagaaaatggactaggagcagtcgatgaaattagtgacgatcatcaaattcatgataattaccgaattgattatttgacgcaacatgttcgagaaatgaaaaaagcagtagacttagatggagttgagttgcttgggtacacttggtggagtccgattgatattgtaagctattcaactggcgaaatgaaaaaacgttatggatttatttacgtagataaagataatgatggaaatggtactttaaaacgttatattaaagattcattttatgtatatcaggaaattataagaacaaatggtgagtgtgttgatgaaaaaaaacgttatactttaaatagtcaattaaaggatgttttggaaataaaagggcttagagaaattattaaattagttagtgaaggaaaagttactgaccttcaattaaaactagggggacgcttaaaaataaatcaattacttgataaatttgatgttaatgataataatcaaagattgattatagatttactgaatcgtttagaggctaaataatgaaaatgtccggaataattaaccggacttttctatttattcaataatataagcattaatgatttggccataataagccgtgtgtaaatctttatttgctccatagaatgaactatcaacatcttgaggataaaaacgttctaaattgtttggagtaattgcatttttatcttgtacttgttgatagacaattttacattcaagtgtcaaaggaagctctttaatacctggaactgatattttatcaggatcttctaaagtaggcccaagttctttaactttatcaatatctcttcctgatttcgtaccgcaaacccctaagattttcttatcaaaagcacctaaaggaatattgattgtaaattcaggatttttttctatctgttctttagtgaaacgatgttctcttacaaaaacagtaaataattctgttgctcattcaattcctaaggttccccaggaaattgtcatactattgactttatcatcaactttagctgttaaaagaacgccagtttgaacagcttccataatttctttagcataatcaaatacatttatttgttttttcatctaattagcctccttgttattttaataactatatgataaattagaactaaattaataacaagtatacacttataagtaaaatactatctaaaaggagagtaaaaatgaacgatgaagtaaatgtaagaccatttgcatatgcaatgtctttgatcgatggcaaatggaaaatgcacatattattttggttatggaaaaaacaagtactacgatatagtgagttaaaacgtgcattaggaacaattacacataaaatgctaagcactcagttaaaagaattggaaaaggacaacttgatcattcgcaatgagtatccgcaagtcccgcctaaagttgaatattcattgtctccacgtggtttaacattgatgccggtgttagaatgtttatgcaagtggggacatgaacacattaatgatggagataatcatggataaagaatattattcgataggtgagattgcagaaatttgtaatattccgataaggaccttacgttactatgatgaaatcgggctattagtccctgaaaaaagggatattgaatcaagctatcgttattacgctagacatcagatattacaagctaatattattaatcaatttaagattcaggggtattcaattaaagagattaaacatcagcttgcaaataattccgtttctttgagtgaagaaaccttgaatcaaaaacatgctgaattaaaaaaaacaatagctgaattaaataaattagagaaacgtttaggattctttttggagtgtctaaagtatcaagatcatcagttgcatttacaattaaaggaaataccggaaatttatattgcttatgttcgtcaacaaggtttagcagaccaagcagcctttatgcgtcgatttagtgaattaaatactttatgtcgtaagaataatttagagccgataggaaatataatggcgcgttattatgatgattatcagcaatatgatcccgattgtgctgatgttgaagtttctattcaaattgatttaaatcatgaaattggtggagtagttagaaaagaacctggttatttatgtgtttctgctcttcattatgggccttatcgagatgaatataagacttatactcttatgatggaatggatgaaaaaaaataatttagtaatgtgtggaccagcattagaatattatttaatagatcctatctttactaatgatgaaaatgaatttgtgactgaactaagaattcctgtaaaaagcatttgactctctagttactagaggctttataataaatttgaggtgattagatgatacatttagtatatttagacaataaagaaaaagtcttagaaaagattatgagtggcaaaaaaacaatgataattcgaggagcagcaggacgcaagattcctcatagtagagtattcaatgacgaagtattatatttcatggaaaaaggaactaaaaaaataacagcaaaagcaagagtagttaacgttttaaattttattaaattaagtgaagatgaaataaatgaaatattattaaagtatcaagataaattagatttaacgccaaaacaacaagttcgctggcataaaaaatgtttgtgtttagttgaatttacagatgtagaagcaattaaaccactagattttgatcatcaggggaatatggatgattggttgattcttgatagaattgaagatgttgtagtaggaacgagtatcccctacaactataataatgctagatttaagtaaactgccggaagggtagttttttttaagaaaatttttaaggattattaataacaataaattggtaataatgatagaataagtcatattgggggtgtaaaaatgaaagataaattaaaaaactttaaacatctcttttttaaaatcctaaaatttgagattttctataaatttgcaatattcctaattatcagtccattgattaataaaattcttcaaatatatttaaataataattccagcggagctgcatttaaccaatacatattatttaatttcttaaatcttgaagggattacagttgttttaattattatgatgatggcagtaattgcaattggatatgaatttagtgtactgatcaatatgattactttaaataagcaaaataaagattttcgaatttatgaggtaatgaaaacctcgttattaaatttgagttgtttaaagcatcctagtagtattttaacaggaatattctttttatttattttaccattagtgcatcttggttatataaactcattgataccaagtttaaaaattcctaattttatttttggagaattgagcttaacttttcaagggaatattttaatatgtttaatctatggattgtattttggaatttatggattaatgttttttgtaccggttttaatgattttaaaaaaagaaaatattattaaagcctttaaagaaaatataaagttccataaattattgacattaaaagaacgtatttcattaattggaataatgggtatttggatcgttcttgagaatggattaattcaaatattaccagatgctttaataaaaaatgcggattttaatcgttattttttaaagaatttaattatttcttcgagatttagaatttatttattggaatacatcatatatacattaataatcatggttttgatgattgttttctatcaatatttaataggtgttatgggtaagcacgagcctgaactattgaaagtaaaggtggatttagaatttaatcgcttatttgaccgaactttattaaaagcacaaattcatggtaatcgtttttttcaaagcttggataaatatttttttgaaacacatttttatcaaaagtatcgtgggatgatcaaccttgttttttggccctgtatgttcatcttgattacttatctttttcctaattcaatatatattttatcagctatcttaattgttgttttgttgatgtattttgctgctagtattattattcgttatgaaaaaagaaaaaatggtcaggaatttgaagatgatagtgctttgctgtttttgccttatcgcttaattaaacgaactttaaataattctcgcttatataatcatcatcctagaatggttacagcactcttagcttttatttctgtttgtctagtaggtatgtatttagaacaaccgttgatgctccatcatccatgggtaatcggtcatcgtggttcaatttacggggttgaaaatacagatggagctatcatgacagcagctgataaaggagcggattatgcagaaattgatgtgcaattatctaaagacggggttcctgttgtgattcatgatgcagatttgtcgcgattggcacataaagatgaaaaagtaaaaaatatgactgctaaacaattaagtgaaaccttggtttatcataacgaatacactgataaaattccgacgctagatcatttgattaaaaagttaaaaaagaatagcactaaaatgggacttttgattgagttaaaagttgagggcggtaatggagaaaaactagctaaaaaaattattgatgttatagagaaaaatgattatcaaaagcaggctatctacatgtcgcttgatttagatactgttcaatatcttcaaagtcagcgtcctgaatggtggattggatattgtatttatggtagtgctggagatattgaaggatcattatggaaccaaggtatcgactttttggcgatagaagaaaatcgagctacagtgagttttgtagaaaaggctaatcgtaattgggttcctgtttatgtatggacagtagatgatgaaagtaggatgatacagtatcttgaacttggggttagtggaatcattactaattatcctaatcgggggagaaaagcagtcgataaattcaaagagaataattatcagtattattatcatcatgggtcaggatatcctgatagttaaaactagattgcgatctagttttttttctaacagttttgtaaggttggttaaattactaggctatcttaagaggcgatagtataatgaataaaaggagttgaagagaatgaaaatcatgatagttgaagatgatttgatcttggcgcgtgaattgcaattattatgtgttaagtggaattttcaggcaaagtatcttgaggattttaagcatgtagatcaagtatattgtacatatcagccggatttgattttattagatattaatttgcctttttatgatggtttttactggtgtcaaaagataagggaaaattccacagtaccaatattatttatttctagtcgagagcaaaatgctgataaaattctggcactgtcagctggaggcgatgattatattgaaaaaccatttgatttagaattgctgttggtgaaaataaaagcaatattgagaagaacttatgaatataaacatttggaaaaagaatatcttgatgaggatacctcttatgatattgtgagggggcgatttgtatatcaaaataaagttttagaattgactaaatcagaaggtaagataatgtcgacactattagggcaacgaggcaactgggtaaccagggaacagttgatgatgacattgtggaatactgatgaatttgttactgatgcgactttatcggttcatatttcacgtctacgaaataaattaaaggaattaacgaatggaaaagatattattaagacgaaaaagggagtaggttattatattgattaattatttaaaagagaaattacggcctattgtaggtggaatgttagttttagtatttattaatatttattttttatatttgtgtggtagtcgcttatatttaagtgatctggtttatttggatgttattttaatttttattgggattacgatctttatttatggaaatgtgaaataccgagcagttgaaaaaataatgaaaactaataattttttgaccacaaaggaattaaaaagctatttatcgttgcaagcacttagtgttattgagcaaaacgatttatattatcatgaagaaattaatcacttaagtactcaaatacaagaattatcggattatatttctagatggtcacatgaagctaagttgccgattgcttcaatgcgcttaatgaatgaacgtaatcaagatctagttttaaaaaaacaaatgcgtttaactattgaacaaattcaattattattaaatacaatgttaatgtctagtaagcttagaaatcctgtgaatgatattaaaatagagaaagtttttttatctcaagttattaaggaagcgataaaacatcaatcttatttcttaattaatgatcattttaaaattaatttaaaggtagagaatgagtatgtttatagtgatcggcgctggttaacatatatgctggaccagttcattaccaactcgattaaatataaacaaacagaaccaaatttgactttttatattagagaagatcatgatggattagaacttattgttgaagataatggaatcggaattgcaccggaagatgctccatatatatttgaccgtggctttatcggtcataatcttcgtgatggagactatcgctcaacgggaatgggtttatattttgttaaagagatagcagagaagttaggcattaaagttatctatgataatactttttgctcaggaagccgctttaaattacaatttgaagataatgcagaatatttcatgctagattactaaaatgtaagattatagagctaactgttagataagcgttaggattttttcttgattagttggtaaactttagttgtaatctaaggaggaattaaaaatgagaaagattgtggaaataaaaaatctcgttaaaagttatggtggtaaagattatcagactaaagtattaaaaaatattaatttagacatttatgaaaatgattttattgcaattatgggaccttctggagcaggtaaatcgactttattaaatatgttatcaactttagataaaccaactcgtggtgaaatcattattgatggtgaggatattacaaaggttaataataagcggttgtcgaaaattagacaggagaaaattggttttatttttcaagattataatttattagataatatgactttacaggataatattgctttaccgttgagtttaaatggaaagagaagccgtgaaattattgaaaagactaaacagatggcctctttatttggattaagtgaacatttaaataaatatccttatcaattatcagggggacaaaagcagcgtggtgccagtgcacgagcattgattactaatccacggattatttttgctgatgaaccgacaggagcattagattctaagtcaagtaaagatttattaatttctttgaaaaaagcgaatgagtcaggcaatgcaacgattttaatggtaactcatgatgcttatagtgccagctatgctaaacaggtttatatgcttagtgatggagcaattaaatgtcgcttaaatcatagtggtgagcgacaaaagttttatgatgaaattttaagcttactagcttcgatgggaagtgaacaagaatgagtttatttaaattagcttattcaaattttaaacgcagtgtcaaaaattatgttgctttgattatttctttatcgttttcaatttttacgttttttaattttcaaaatattgttttttctaatgcgatggatgttttaaaagaaaaaaacagtgattatattgcaattattattcaagttatttctattgttttaataatttttgtcttcttttttatctggtatgcgacaaatgtttttttatcacagcgtaaaaaagaaattggaatttttacttttatgggactggataatgtaaaaattggtaagatgtatgtaattgaagttgcgatgattggacttttatcattaattattggcctagggagtggagcgcttttttctaaactttttacaatgttgttattacgcttatcagatataagcgtggatgtttcatttagttttagtattattcctgtattactgacaaccgctttatttgtcacgatttttgctattatgattattaaaggctatattaacattttaagaagcagtgttttagatatgttatcagcatcaaaacaaaatgaattacgtgaagaaaaaataattattactttattaaaagtggtaattggggtagttttgatttgtggtggctattatgctgcgatgatggttggtgatatgtcttcgtttatctatatattttatgcagtagttttggttgttgctggaatctattttctatataatggggtaattccgtttgtaattaaaaagttagctcaaaacaaaagttatctatatcaaaaagaacgctcattgtgggtcaataatttagcatttcgtttaaaaaagaattatcgtgcttatgcaatggtaacgattttaatgatttgttcggttaccgttttagcaacctcatttgcaatgaaacaacgctacgataatatcagtcattttagaggtacttatacttatactgtgatggcaaataaagctcttgatggcaaccaaattgctcaaaaaatcagtagtaataatgagctcaactatcataatagtctaaactatattgccttaaatgcagatatggttaaaagtaaatatctatataatcagtatggtgtagtttcatatagcctagccagttaaaaaaagccgcaaaagaggctaaaattaaatttgatataccaaaattagatgatcagcaagtagttaatttgacgagattatatttacttgatatctcagatcctgaaattaatccggtgatagaaattgcaggtgaaaaatatcaaattgttgatgaaactgcaacatcatatttaggattattgcaagaaaatattagtacctatattgttagtgataacacatatgaaaagttaagaaattttggacaagagttttatatgtataactatcaaataaaagatcctaataattatcaagcatcgattgattatttaaatagtttggtaaaagatggacctgtagattatgtgagttatttagccaatgatcctaatggtggggatattgcttgggttcgagtaatgtactctatttgtattttcttgtttttagtattcattttagctagtggaagtatcatttttatgaaattgagtaatgaggcttttgaggatcgagagagatataatgttctaaaaaaactaggaatcagtaaacgaacattgagtaggtcaattagaaatgagatacgttttgcttattattgtccttttgttttgatggtactgtcctcatatttttctgttcatgcgctagctaatgttatgaagacagaactatacactgtaaatattgttagtgctatcgttattttagtaatcttttatataatctatactatttcagtattaatgtttaaaaagaaagtattgagtgatcattaaataaaagcaggatgaagtttaatttgtcctgttattttttactaataaagcacttgcagcaagcaagcaagaaaagaagatacaagtaaattatatttggctattgaattgtagaaataaaactaggggtttaattacataattattatatttaataattatgttgataagctattaagaaaaaacgttgaaataatagaaatatggtataattaaacatattaacttgttaggaggttaaatgatgaaaaaaaaatcaggtattattgaggaatttaagaagtttataactcgaggaaatgttatggacatggctgtaggggtcattgttggtggtgcttttacaacaatcgtaacttcacttaataatgatattatttcaccgattttagggatttttggcggagttgatttttctgatttaaaacttgtcatggggagtggtgaaaatgctccagttttaaagtatggaagttttttaacggcggtgattaatttcttaattatagcaatgattattttcttaattgttcgtgcaatgaataaaattaatgaaagtatcaaagctaaattgactgacaaggaagaagtgctggttgaaacaacaaaagtatgcccttattgtagagaaaaagttgcgaaagaggcaacccgctgtcctcattgtacttctattctagaagaaaaagttgattaagcaggagttgacatgaaagatattataattaaaaatgcgtatcatggtaatttaaagaatcttgatttgacgattcctcggaataaattagtcgtaatcactggtttatccgggtcaggtaaatcaactttagcaattgatgttctttatcaagaatgtcagcgacagtatttagaagcaatttcttttcaaggaattaataaaccaggagtcgaagtaataagaaatgtttcaccagcagttgtaattacacaggatgaaaaaaataataatcctcgttcttcactgggaacagtaacagatatttacactgatattcgaatgatttatgaaaagctaggagttcgtaaatgtccccactgtggtaaaatgattgatgcatcatactgtcatgaagaattagttcgagctgataatgattttactgtttatatgtactgtaattattgtcattataagatggaaaaattaacaagatcacatttttcttttaatagtgaaaaaggtgcctgtccaacttgctttggattaggtaaaacattaatacttaatttagataaagtacttgagccaaacttatctcttcgcgagggtgcagttgcattttggcatcatcgttataaagaatatcaaatcgaacaattagaaaaagtatatcgagaactggggctttcagtgactccggaaacaaaagtgattgattttaatcagcagcaaagagtgatcttattatatggaactgaatcaaaacagtttaaggaactttttggtaaaataaaaataagtaagtttgaaggaattataactaatttatggcgtcgggttgaagaaaagaaaaatcaaagtaaagaaataagcagttatttcgatgaacaggtatgtcctgattgtcatggtgaaaagcttaattcattaagtcgtcaaattacagtgaataaaacagttattacagcaacaacaaaaatgcctttgacggaattactacattggcttgagcagctggaagctactgtttcaggaccacaaaaagaagctgtccaacaatatataattgatttaaaaacaaaaattcaaagaatcattaatgttggtttaggatatttgcatttagatcgtcaaacaatgactttatctggcggtgagaaacaaagaattaaattggcagcggctttacaaagtcagttaacggggataatttatatttttgatgagccaacaatgggattacatcctaaagatacagcaggaattattaatgttttaaaggaattgcgagatcaagagaatacggtgattgtaattgaacatgatttagatgtaattaaagcagcagattatttaattgaccttggacctggtgcaggaaagcatggtggtcaaattcttgcattaggaacttatcacgagttgcaaaataatcctagttcaataactggacaatattttgttaataaaaagaaatgtaaaagagtatatcgaacaagtaatcgatattttgaggtgaaaaatgctcatgttcataatttgaaaaatattgatgtaacttttttagttgattgtttaaatgttgttaccggtgtatcagggtctggtaaaagtactttggtgtttgctgtattagctaaacagcattatcgatattttgatgatattattgctgtcagacaagaaagtattacgacgacaaggcgctctaatattgctacatatacaggaatttatgatgaaattagaaagctttttggaagtttagaagcaactaaagaaatgggttttacggctaaacatttttcttttaacagccaaggaggacgttgtgaaaattgtgaaggattaggaactgttactagcaacatgttattttttaaagatgttgaggttgtctgtccagtttgtcaaggaaaacgtttcattcctgaaatccttgcattaaaatatcatgaacattcaattgatgatgtgcttcatttatcagttgatgaaggggtaggtttttttagtgattgtcccaaaataattaaaactttaaaaatgctgcaagatgttggtttagggtatttagaattaggacaagttttaacaacgctgtcgggtggtgaaaaacagcgtttaaaattggcaacgacattactaacaaacataaataaacataatctttatttaattgatgaaccaacaattggcttacatcctctggatattgagcatttactacttttgcttgatcgtattgttgatagtggtaatacagtagtaatcgttgaacataatcagcagattatcaatgctgctgactggatcgttgatctggggccagcgggaggaaatgatggtggttatgtaattgctgctgggacaccaaatgatataaagggtaatgagaattcaataattggtgaatttttgtaagaacttctacgaagttcttatttttatgcatattatttgcttatgcaatagctctgaggtagaataatgtcgaaatataacagtgttatattttggaggtgactatgactacacaagaaaaaattataaatgttgcgactcaggagtttttaaatagtgggtatcttggtgcatcgctaagaaaaattgccaaagcagctcatgtaacaactggagcaatgtatggatattataaaaataaagaggcactttttaatgatattgttgaagaagtgtctgaggaatttaaaaatgattatttggttgagggaattaatcttgagacgattgattacatttatcaaaattttgaagtttttaaattaatcatttgctgtagtaaaggaactcgttatgaagaatatttagattgtttagtaaatgaaaaaacgaagcaatttaatgaacatggttttgatgataaattatcacatattattaatcattcatatttatttggtgtttttgaaattgtccgtcatcaaatgactgagaaacaagctgaggattttgtcagtgatttacaagaattttatcaggcgggctggaataagttattagaaagaaaggaaatataatatggaaacattaattggaatattgattccgtttattggaacgacggcaggggcagcgtgtgtctattttatgaaaaataaaatgaacgatttagttcagaaagtattattaggatttgcttcgggagtaatgattgcagcttctgtttggtcactattgattccggcgatggatatgtcaagtgatttgggaaaaatggcgtttgttcctgcagcagtaggttttctattaggaatagcttttttgcttttacttgatcgtaatgtacctcatatgcatttggataatgaagaagagggtcctaaaagtcaattgaaaaaatcaacaatgttagtcttagcagtaactttgcataacatcccagaaggaatggcagttggagttatttttgcgggattggcatctggaagtcagggagtaacttatgcgggagctttagctttatcgctgggaattgcaattcaaaactttcctgaaggagcaattatttcaatgccgttaaaaagttctgggttatcaaagaacaaatcatttatatatgggatgctatcaggtattgttgaaccgattggtgcaggattaactattttgatggcttcattagtagtaccgattttaccatatctattagcatttgcggcaggagccatggtttatgtagttgttgaggaacttattccggaggcttcacaagggcatcatagtaatattgcaactattggttttgctattgggtttgtcgtgatgatgatgttagatgtcgccttaggttaatctttacataatcttaagcacagttgtatagtttcgtttctgtaattaagtaaaatgaggttaaagaggtgacagaaatgaaaaagagattagggttaggtttgggaatgtttttaataacaattttatctaatttgtcaggagttatggcttatagtggtaatagtaatttaccgggaagtgcaataattattgtttttgtaccggtaatgttaggaattatctatttagctagtaagggtgaggttaaataactaaaactttacatagaattaaagcagggatgatataattttaaatgagaatattagataatttagctatggtatagatggattggttataaaataatgctaagtcctttatgcacactataaaattttgattaaaagactaatcatatcttatacctgctctatttgaataactttccctatgtatatgaaagatgaggcaacagcctcatttttcatatttcataaattccaaaatttaacattttgttaacaaattgatgatattattagtctacaaaataagtattataaagataaggataaacatatatttagtaaggaggcggttttaatgaacaaattagctttagttgcgataagtttatttgtagttgtagaaattctagttggagattgcgtagtccagggaattcctctttgggtagttggtttaattggttttagcctaatttggatgggaataatttgtgtaaaagaaaaagtccaaatcaaagactggtattaaaaaaaggaaattatgatttccttttttttatttatgtttaaacatttcaaatgatgaagcaattaataaaaatagcatacctgtgtgtacccagaaaattgtataatcaagaacaccatgtaatagaataactgcaatgcatgaaattacaagggcgacataacggagatttagcttttcttgatagaccttaaataatcttttacaattatcaaacatataaggaacaagagtagcaacgccaacgacaccaaatgataaaatcggatcaagatagacgctgtgagcatgttgagtgacatgaccaccatactgtttaaaaatcatcatatatgtcattgggccttgaccaaagagcggatgggctttgattccttcaattgcagcatgccagatctttgttcttacagtaaagttatcaactagtttttcaattcttgggaactgttcaggattaaagataaaataaataccaccaatgatacaaagtagcccaattaaactgcaaatccggtaatttttattgatgatcaagaatactaacattgctccagcggttgcaacaaaagcggtacgacatccagtcatatataataaaaagaaattaaggcaggcaacgataaaataataaagctgttttttgacatttttagtaccaaatattttatatccaatcatcatgatggtaaattcaatcatcatggcatagtaattagcattgaagaaaacagaattaagacgattttcacgtctgctaaatacttttaaagtaaaatgatcataacctaaacgatcgagaatttgaatttgttcaaatagtccataaatggtccatagaatcgataatgcaattaacatatctaaaataaattcaaaagtatcttcattgatatattgtcgataatataacattagtgaaacaaagataaagataagtgcgacacatcctacaccaatccaattttgataaattaaagaaatagctaatgttaaaagcataaaaattattaaatatttagattttggggtacttttaaacgcatttataatttttttagtgtacaataggtataatgtttcaagtaataaaaaaggtacacaaatataaaatggggtagataaactaagggcggtagcaataatcattaattgttccttagtaaaacgttcttttaatgaattgataaatttcataatagacctccaagtactgttactatagcataaatataaaatagacacaaacaaaggagatataatgaaaaagtatttatatgtttttaactatcccccagaagataaagaattatgtgctttagaatttagaacattatttaaagatgaatttaagagtaaatattatttatcaaataaagattatagtgttgataaaagtgtttttgtaaaagcaaagctcgatctttggggaatagatgctgattttaataaactaatcgaaaaagtggctgcgctgcataaagattaccagaattttaaagtaatatatttaaaaaatgaagttactcatgttgactatcaagaaagtttacttaggtgtaaagatatttcttggggtattgcaggaagtgttaatatgtctagaccgcaacatactatcgcgattacaaaattagaagatcaatggctttgcggttattatcatcatggtgttccgtcttggcaaaaacacgatgataaacctaatactttttctaattctttagatattcggttagctcgaactttagttaatttagcagctggagataatgatcaggtaacgatcgttgatccttgttgtggtatggggacagttgttctagaaggactcgctttagatttagatattgaaggattcgatatttccagggaaatatcttggcaagcacgtaaaaatttaaagtattatggttatgatgagtatttgattaataaggtgagtattcatgacttacaaaaacattatgatgttgcaatcatggatatcccatataatttatatactccaataacttacgaagaacagtgtagaatgattcagtcctcgcgaagaatttgtgacaaaatgattatggtaacttttgaggaaatgagtaaagaaataaatcaagctggctttttgatcattgacggctgcttacgtaaaaagacagaatatgttaaatttggacgctatatttatatttgtatttaataaaagcaacatttagttgcttttatttatgttttatgattttttgaagataaggtatttgtgataattcttcaacattatctttatatagaaaaagcaatgttccaaaatatataatgactccaataacgattgcaataaatagagtgataatcaaacgatcaataactttaattaaaccatagtagcatagcgcgactgtaaatgccataattgctgaactaatcaatgggtagatgaaggtgtgtaatttctcttgataataagtagtaatatgttttaaagctctttgatttgcgaaacaaagctgtaaaccataaagacagttaccgatcaatagagaataaatatttaaattcgttgcaagtaaaagaaatagagtaataaaacaatggataattaacgcatatatagcattttttaaaggaatagatgaatatcctaaagcttgcaataatccattggtataggtagaaagaccatagaaaacaattgctggactcccaaatgttaaaagggtgctggctagaacaaccgtttctttttgcggaaaaattgcttgaataatcggaactgcaagaatactcattccaacggcactgggaataaggatcaacatgatgacttttgttccttgagcaatttgttttttaacttcagcagtatctttaaatagccatgctgatgaaatattgggaattgaagctgttgacattgctgaggcaagagctacaggaacgttttgtaaaataatatactcacccccataagccccaaaggcactgatggatttggcaccatcaccacaaactagataaaacatatacatatcaatagttgagataaggttgtaaacgcaagtagccaaaattattggagtaacaatatttgaaatcattttaaagatatctttaaacgaatctgtatggggatcggctgcttcgatatttggaggatttaaataactttgtttagttcttttgaacatgaacaacatataacataagctgattagaactccggcgccagtgcctaaggcactaccagttgccccgtgactagcaactagactttgattattaaggtatggttgaataaatagataagcagctccaattgaaacacaggcattaaatacttgttcgattatttgtgaaattccagtaaaggcagtagttttaaaggcttgaaaataacccctaaaaatccccaatagtccagaaagaaagatcgttggacaaagaattcgcaaagctgaaacagctttatcaggaacaatatagggtgcaattacaaatgcgataattgctgctcctccaccaactgcaacaatataaataaatgagcaaagaagaatctttttaacattattatattgattaacggccagtttttcagataacaacttagaaatagcagttggaatactgtaagaagaaactaaaagaattagtgcatatacattataagcagtagaatagtaacccattccttgtgaaccaatcagtttagttaatggacttcgatataacagaccaataattcttactaatattccagcagcagctaaaaaagcagcctgtttaaaaattgaattctttttcataaaataaactccttatggataataatgtcatattatattaaccataccatttattgaaggataaatgtatgaaaattttaattattaataagattcttgttttaattattttattttatcataaaaagataattagttctttattgtcggtagtttaaataaaaaagataaaatatgttagaatagggtgattagaaaattaattttatatttgcttgactctccggtaaggggagcttatacgatgtttatggaaggtgataagatgttttcgattggtgagttttcaaaaatggctaaaacgactgtaaagactttgcgacattatgatgagattggattgctggcgccggcatatgtagatacttatagtaaatatcgtttttatacgagtaatcaattagtaataattcatcaaattcagtcattaagacaaataggtttatcattagatgaaatacagatgattattaatggtgttgatggtgttgcaattctagaaagtcggaaaaaagcaataaaagaaagcattagtgaagcagaagatcaactttcacgcattgagtttattttatctggcaaagaggaggatacatttatgaattatcaagcaagtattaaagaattaccagcatgtaccgtatattcgaaaagaatggtagtccctgggtatgacagttattttgaattgattcctgcaataggtcaaaaagtgatgaataagtacccggacttaaaatgtacagttccagaatattgttttattatttatcgagatggtgaatataaagaaaaagatattgatattgaattttgtgaggcggttgatcaagtaaaggtagattttgatgatatcaagtttaaaaagatgccggcggttaaagcagtatctataatgcataaaggtgattatgcgggattacctaaagcatatgcgtatgcttttaaatggattgaagaaaatggatatcaggtacttgataatccccgtgagagctatattgatggaatctggaataaagaaagtaaggatgaatggctaacagaattacaaataccggtgactaaatagcggattgggaattagattaaattctaattccttttatttttgtggaaagatagggtataataaatccagatttggggggttagacaatgaaattattaaaatatgttaaagagtatcgatttcccgcgataattggatttgttttcaaaattgccgaagcagccttagaattaatggttccattggtaatggctgatattattgatgtaggaattaaaaacaatgatcaaaattatattttagtaagggggttatttttggtaggattagcggtggctggttatttatttgcgttagtatgtcaatattatgcatcacttacatcacaaagtgttggaacaaaattgcgtgaagatatgtatcatcaaattaatcgttatgatcatcataatttggataaattaagtgcgcctaccttagtaactagattgattaatgatgttgtacaaattcaattggcagtagcaatgacgatccggttaacttcacgggcaccgtttattatgattggttccttgtttttagcgtttttgattagcgggccgctggcttctatttttgtagttggggctatcgttttagcaattgttatgttgatgattacaataatttcaatgccgtattttaataatgttcaaaaaaagcttgataaaattagtttgatcgttcgtgaaaacttaaatggaattagagtaattcgagcatttgcttcacaagataaagaaattaataagtttaaaacagaaactcggcaacaaaaagatatccaagtaaaagtagggagaattcaagcattattaaatccatttacatatctgattgttaatgtggctattgttttaatagtttattttggtggaactgaagtaaatgttgggggattatcgcaaggggaagttattgctctagttaattatatgaattctattttattagccttgattgtttttgctaatgtgttatcgatctacaataaagcaggtgctagttatacaaggatttttgaggttttggaaacagaaccggcagtagttaatgatggacaaatacaaatatatcgagaaagtgaagattgtattgaatttagacatgttagctttgcttatgaacaaaaaaatgttttaaatgatttgaattttacgataaaacgtggtcaaacaattggaattattggtggaacaggagctggaaaaacttctttagtaaatttaattgggcgtttttatgatgttagcagtggcgagattttaattaatggagaagcgattaaaaattatgatcttcatgctttacgttcttttattggatttgtaccacaatatgcagctcttatttcaggaacgattagagaaaatttacagttaggaaatcaaacagccaatgatcaacaattgctcaaggccttggaaattgctcagggaaaggaaatgctcgaagataaagcggctggattagatacagtaattgaacaaggcggaaagaatttatctgggggtcaaaaacaacgtttaacgattgccagagcattagttaaacagccggaaatcttaattcttgatgatagttcaagtgcacttgattatgcaactgattttaaattgagacaagcattgaaacaacttaatatgacaaaaattattgtctcacaacgaacagcttcaattgaacaggcagataagataatggttttatatcatggtgacttggttggctttgatagtcatgaacagttaatgaaagattgtaagatctatcaagaaatctatgcttcacaacatagtaaggatggtgacgatcatgaatagtaagacgataaagcggttattgacatattgtcgaccatatcgtgtgattttaggtttaatatttatcttatcttttattagtgtctgtttgacattaattacgccaatcttatttggacaagcaatcgatctattaataggaataggactggttgattttagtcgtttgttttggcagcttctagtgattgtaggagttgtgcttgcgggagcattagtccaatggatcttggggcaattaactaataagattacttataatataacgaacgatcttcgtgatcgcgtctttgaaaagattcatttattaccattaaaatatattgatagtacgccacatggtgatattattggtcgagtaattaatgatattgatttgattgcagcgggtttattgcaaagttttactagtttatttactggtgttgcaacgattgttggaacaattattataatgtgtttgattaatttatcaattgcaatcgtagtgattgttttaaccccgttatcattactagtcgcttcactaatcgttaaaaggacccatatctattttaaagaacagcttgaacttcgaggtgaaatgaatggctatattgaagaaatgatagggaatcaacgaatcattaaagcctttaattatgaacaaatgaatgaagaacgttttaaagaagtaaaccaacgaatgcatgtaagtggtgtaaagtcacaattttatggagctttgatcaatccgacgacaaggattgttaatagtctggtgtatggtgcggttggagtatttggtgcaattagcgtgttaaatggtagctttacggttggtttattatctagctttttaacttatgcaaaccaatataccaaaccttttaatgaaatttcgtcagtaatgacagaaatgcaaacagctttagcagctagtcagagagtatttaatttattagacgaacctgttgaaaaaccagtcagtaatcctcaaaacgttgaaataatggaaggtaatgtttctttaaaaaatgtatactttagctatgaccctaaagtatcattaatagaaaatcttagtttagaggcattaccaggtcaaacaattgcaattgttggtaaaactggttgtggaaaaacaactctaattaatttattaatgcgcttttatgatcaaaatagtggaagtattatggttgataatgttaatacattagatatggagcgagattatttacgtcgtatgtacggaatggtattgcaagagtcatggatatttaaaggaactattaaagaaaatatagcttatggaaaaagcgatgctacagatgaacagattattgctgctgctaaaaaagcccgggttcataaatttattatgaaacaacctgaaggttatgatactatgattgatgaagatggaggaaatatttctcaagggcaaaagcaattgatttgtattgcccgaattatgttaacaaaacctccaatgctgattcttgatgaagcaacaagctcaattgatacacgtacagaattacaaatccaggaagctttcgaaacgatgatgaaaggtcgaacgacatttattgtggctcatcgtttatcgacgatcaaaaatgccgatatgatcttagtaatggataaaggacatattcttgaacagggaacgcatcaagaattgttagagaaacaaggttattattataatcttcataatagccaatttaatttagctaagtgatagatatttaataaaaaagatacaataagctaaaatgattataaactataaaggtaaagataactgctggaggtaaactttagcagtttttattattttaaaggaaattattcaaaaagtattttgtgtataaaagaagaaatagggacataaatattttatacactaaaataaaaatatatgattattatagtttagtgtataattgaacttgtaaaaattaaaagaaagcgtatacactacttataaaatatgctctagtgtattaaaaaatgatgatttatcaagtttgcgagaaataattgattattttatagttgtaattggctagagcaagtagtgtcaaaggagttagctatgaaatcaaacaaagtaaaagtatttgagttcattaaagaatattcaattactcaaagtacagatgaatatcctaaattgacaactcagtatctatccgaaaaattagacatgcaaagaactaatctaagcagtattttgaatcaattggttaaagaaggaaaaattactaaaacaactacacgtccagtactgtatcaattagcaaatttccaattgactaatcaaaaagactttgagaatttaattggttataaccaaagtttgaatgaagcagtgatgctagcaaaagctgccattctttatcctcaaggaagtcctcatattctcttaactgcagaaagtggaagtggggttaaatattttgctaaaaacgtttatgactttgcagttaaatctaaagtattaaaaaataatgcaccatttacagttttcgactgtaaaacattcattgttttcgactgtaaaacattcattgaaaatccgacgattattaatgaaatgctttatggtgatgaagtgaatactggactagtacatcagactaatcaaggcatgctgttgattaaacatgttgaacttttatcagggtatcaaagaacaatgttattttcaatcattacaagtaataagatgccctctaatcaatatgtagaattaccgcgtaattataaatgtatcatgctttgtgcaatagccagtgatgccagtaaggatctttatgatctctatcgtaataaaatggattttgttattgaacttttgccattaagtcaaagacccttaaaagaacgatttgctcttttagaattgtttttaaaacaagaagccagaaaacttgatcgggttctagaagtaagcactaatatattacactccttattattatatgaagtgaaggacaatatccgtggtttaaaaaatgatattcatacaggagtagcaaattgttatgtaagagaacatgatgttcatcatcaccatattgagttattgttatcagattttcctaattatgttcgcaaaggaatgatttactataaaacatttaaagaagaaattgatgagattattcctggagattgtaaatttgcatttactaaaaatgaggtattaaaaaatagagcaaaggaaaataatgctaatatttatcgaacgattgatgttcgtaaaaaagagttaaaaaaacaaagtgttagtgaggaacaaattaatactttagtttcattacagcttcatcaagattttcaagaatatttaaatgaattgagtaatcgtgtaagtgataaagagcaattaagtaaaattgtttcaatgaaattaattagtttagttgaacgtttcattactcgtgtaagcagtgaactagcaataaattatcaagaaaatattctttatgggttatgtctgcatattaatgcttcactaattaaagtaagcagtaaacagcgtcttgcaaatgaagaaattaagcggatgattgatctttatcctaaacattatcatcttgctaaagaattcgttcatgaaattgaagaagaatttagggtaaagatgaatattgatgaaataatctttacaatgctgtttattttaaatgagagtaagcctgtaactaataaacatgttgttactttgattgcgatgcatggtgacagttcggctagttcgattgttaacgttgttaacgctttagcaatgcataacaatacttatgcctatgatttgcctttagataaaagcatggatgatgcctatgaagatttgaaagagcaaattataaagattgatcaaggtaaagggattattcttatttatgacatgggttcaattcgaactatggctgaatcaattgcttttgaaacaaaaatagaaattaaatatttagaaatgccagttactttaattggtgtcactagcagtaataaagccagtaataatgattcagttgatgaaatttatgaatatcttcaaacaaagtttaaagatataaaatattttagaaaacaaagtgataagaagatcttagtaataatttcaaaagagcagtcagaagttacaaggttaaagagttatttaaatgaacattttgatttaagtaatgttactgttcatgtaattgaaaatagtgaagctaatcatctatacaatgaaatcaatattattgctaatgaaggaaaaattatcggaattattggtaataatagaccaaatttagctcaatatccttttgctgaagtgagatggctagaacaaaagaatgctaaaactttagaagagatattcattgaggaagatgaagcacgtgatgatattaatgaaatatttgaatatttaaaggatcagttcaatgaggtagatgttgatggaataaaagattatctattggattttactaagagtttagaagttacactagatgcaactttagatgaggatcagcaaatcggtttaatagtacacttggtttgtttgattgatcgaatcagtagacatcaagcaccgattgttaattttattgcatcaaacataattttaaatcatggaatgttagttagtaaggtcaaggaacttttagttcctttagagatggctttaaatatatcaatcagtgacgctgaaattgcaacgattatttcaatcgttaaaaagagataaatagaaagaaggattaaatatgactaaagaagaagcaacaatggttgcctttgaaatcgtagcttactcaggggatgctcgttcaaaattattaatggctgtagagaaagctaaagcaggtgacttagtgactgctgatagattagtagcagaagctaatgaatgtttagtagatgctcataaagctcaaacagatttattgcaacaagaagctcgaggggataatgttgaggttggttttatcatggttcatggtcaagatcatctgatgacaacattattattaaaggatattgttgggactttaatggatgtatataaaaaataaaaatttaacgggggatcgtatatgaataaattagtttcaaatatagagaaattaaaacctttctttgaaaaagtttcacgtaaccgctatttacgagcgattcgtgatggtttcatttcggccatgccgattgtattattttcaagtatttttatgttacttgcatatgtaccaaatatctttggtttttactggtctaaagaaatagaagcaatgatcttaaaaccatataattattcaatggggattttagctcttgttgttgcaggtactacggctaagaatttagcagataattttaatcgtgatatgccggttaatcgtcaaatcaataatatttctgcgttaatggcagcaattgttggtttcttgattgttggggtcgattcgatcgaaggcgggtttgcaaatggctatatggggtcaaaagggttattaacagcctttttagttgcctttgtcgtttgtaatgtttatcgtttttgtgtaaaacgaaatgtaactattaaaatgccagatgcagtaccaccaaatatttctcaaacctttgctgatgttataccgtttgcggtttcagcaatcatctttactatttttgatattatttttaggaatgtaactggaatatgttttgctcaaggtgtaattgaattttttcaaccactatttactgcagcagatgggtatatcgggttggctattatttatggggcaatgtcattattctggtttgtgggaattcaaggtccatcaatcgtggaaccggcagtttcggcaatctattatgtaaatatagcaaataatttagatttattccaagcgggacaacatgctaataatatattaacaccaggagttcaacaatttgttgcaacaattggtgggactggtgcaactcttgtaattacattgatgtttgcatttatgtcaaaatcaaaagaattaaaagcaattggccgtgctagttcgattccggtaatctttggggttaatgaaccaattttatttggtgcaccgcttatcttaaatccaattttctttattccatttattttcgctccgattttaaatgtttggttatttaaagcttttgtagatttcttaggcatgaatagttttatgtatgtattaccttggacaacaccaggaccaattgggattgttttaggatgcggtttaggtttattaacaattctttttgctgcagttattctactagttgattttgctatttattatccattttttaaagtttatgataatgaaaagtgtgaagaagaaaagaataagaacttagatgcagttgaaaaagaagaagaaatgattgaagtagatggaaatactttaaaatcaaaacgaatcttggttttatgtgctggtggtggaacaagtggtttattagcaaatgctttagctaaaggcgctaaagaacaaaatattccattgattacagctgccggttcttatggagcacatatggatattatgaaagattatgatttagttgtattggcaccacaagtagctaattattatgaagatttgaaaaaagatacagatcgtttaggaattaaatgtgttgcttgtgaaggtaaacaatatatcaatctaacaagagatcctgatggggccttgaaatttgtgtttaaaattatggagggagaataaaaatgaaatttcctgataattttgtatttggtggtgctacagctgcttaccaatgtgaaggaagtactttgaaatatggaaaaggtaaagttgcctgggatgattatttaaaaaaagaaggacgtttttctggtgatccggcgagtgatttttatcatcaatatccgatagatttaaaattatgccgtgattatggaatcaaagggattagaatctcgattgcctggtcaagaatttttcctaatggtgttggtcaaattaatcaagaaggggtagatttttatcatcgtgtttttcaagaatgtaaaaagcagggtgttgaaccatatgttacattacatcattttgatactcctgatgctttgcataaaattggtgattttttaaatcatgaaatcatcgatcaatatactaattatgcagaattttgttttcaagaatatcatgatgaagtaaaatattggttcacctttaatgaagtatggccaattgcagtaaatcaatacattgtaggaagttttccaccagcaattaaatatgatattcctaaagcagtttattcaatgcatcatatgatggttgcccatgcgaaagcagtattggcatttaaagagggaaaatatccaggccaaattggaattattcactctttagaaacaaaatatccttataatgataatgaagctgattatcaggcaacaaaaaatgaagatgtattagctaaccagtttgttttagatgcaactttcttaggtgaatacactgatgaaactcttacgataattaaacgattagtcgctttaaataatggaacttttagagttgatctagaagatttggaaatcatgaaaaaagctgctaagttaaatgattatctaggaattaattattatcaaagccactttattcaagcttacgatggtgagaatgatatcttccataatggaacgggggataaaggtacttcacgttttagactgaagggtgttggtgaacggatgtttaaggaaggaatcgaaagaactgactgggactggttgatttatcctcaaggactttatgatatgatcatgcgaattaaaaatcaatatcctaactataaagcaatttatatcacagaaaatggaatgggatataaggatgaatttgttggaggtaagatcgatgatactccaaggattgattatattagaaagcacttattatggattttaaaagcaattgatgatggtgcggatgttaaaggatattttgtttggtcgttaatggatgtattttcttggtctaatggttataataagcgttatggactattctatgttgattatgacagtcaaattagatacccaaaaaaatcagctagctggttcaagcaaattagtgaaacaaaggagttagataagattgaattataaagcaattatctttgattttaatggaacattattctttgacaatgataaacatgttttagcttggggaaaaatctccaagctgattcgtggtagggggatcagtgacgaggagttgcatgagcagtttaatggaacaccgaatgctaaaaatattcagtatatgatgaataatcaagcaacgagtgaagagcttaaaaaatattcattattaaaagaagaatattatcgtgaattttgtaagcaagataaagcatcttttcatttggtagatggagcagtagctttttttgataaattaaaagaactgggaattccttttacgattgctagtgcttcaattaaagaaaatattgatttttttgttgaatcatttaatctggataagtggattgaccctgaaatgattatctatgatgatggttcctattcaaataaagttaatatgtttaaagatgcagcacaaaaattaaaacataatgttaaagatattttagtgtttgaagattctttttcaggaattgcgaatgcatataaagcgggaattgaaaaaatcgtagtaatctgtcctcaggaaaaagaaagtgagtatcgggatttacctggcgttatcatgacgatacaagacttcagtgattttaataaattaatctaggattggctataaaagtcaatctttttgttttttaaacaattatatgtatatttattatctaaaatcctaaaaataattaaaataaaaaaattattatcttgacaaacaataatcataagagtattctatataaaacattgtataggtatatacattaaagggggaaataaaaaatgaatggattattattactggcgctttcgatggttgcattggcagcagcttatgtaatttatggtcgctatttggagaaaacttggggaatcgaccctaaggctaagacaccagcggttgctaatgaagatggggttgattttgttcctagtagcaaatgggaagtatttgcacatcagttttcatcaatcgctggagcaggacctgtaacgggaccggttatggcattgatgtttggttgggtacctacagttttatggattattgttggggggattttctttggtgctgtccaagattttggagcactttatgcatcagtaaaatcaaacggtaaatcaatgggtggtatcattgaagaatatattggtaaaactgggaagaaattatttttcttgttttgctggttatttacacttttggtaattgctgcttttgctgatatggtagcaggaacatttaatggtttttcagctgttgatggttctaaattacagccaaatgctgcagctgcatcaatttcaatgttgtatatcgttgtagcgattgcttttggtttctttttaaagaaacggcatgtaagtggcaaagtgcaagcaatgctaggaattggcttaattgttttgatgttaattggagggattgcttttccaatttatttcagtaaaacaacttggctatatgtcgtctttgtctatattttctttgcttctgttacaccaatgtggttattgaaacaacctcgtgattatttaactacgtttttatttgttggaatgatcgtggctgcagtagtcggcgtactattctataacccaactatttcactaccagcatttactggttttacaagtgagacaggcagctacatgttcccaactttgtttatcacgattgcttgtggagctgtttctggttttcattcactggtttcatcagaaacaagtagtaaacaaatcaaaaatgaaaaagatatgttacaagttggttatggttcaatgttattggaatcactattagcaatcttagttgttgtcgtagttggttctttaactcaattagttagtgacggtgttttaactgatcagctagcttcattagttactgctgaaggagctactccatttactaaattctcagtaggggtaacggcttttgtttctaaactaggattacctcaagaatggggaatttgcattatgacaatgttcgtttcagcattagctcttacatcattggatgctgttgcaagaattggacgtttatcattccaagaattatttgaagtagaaaattctcaagaagcttcagggttgaataaaattcttacaaataagtattttgcaacattaattaccttgttctttggttatttattatcattaggtggttacaataatatctggccgttattcggttcagcaaatcaattgttagcagctatggtattgatttcattatctgttttcctaaaggtgactggtcgaaaaggatttatgttatacattccaatgtgtacaatgctggtagtaactttaagttcacttggtctttctgtatataacatcgtaaatgcatggatgacaacaggaacttttgatttcttgacatcaggactacaattgatttttgcaattttattaattgctttgggagtattagttgctttctttgattttagaaaattatttaagacaaaaaaagtgtaaaaaacattgagtaatttaattactcaatgtttttattatgctattttctttttaaaatagataaaagtagttatcgtaataacagatagaatacctagatattcaaattcaacttcatctcctgtttttacagaagttgtcaaatcatcttttttatcaataactgttgtagtattgctaccattgttgacaaaaatcagttcaccagttagtagatcacgttggtagtttttaaagaaattccaaatatattgggcttctggtttatagttccagtgagcatgatctttaattgcagcaagttccattactacaccgttattgttagacaaagttcctgtatacatgtctttttcaccaagttttgtccattgctgattatccaatttaatgccataataagggtttaaatccatattcatatccgtcacggttaagtcattgattttttgatatgcttgtagggcactatatatatgtgtattactgtcttcagcccaaatactaaaaccatataattgtgaagtaccgtattgacttgaaccatcaacaggaatcatttgaaagaaatcatgatcaccacaaatatataataaaggtgtttcatgtcctttataatcattggttaattcagtgattgcttcactataaagattgacaccagaaacagccccaacccctgcaaaagtttcactattcttgacccctaataataatgactcggcaccgcctgctgataagccggtaacgtatactcgtgatctgtcgatttgtggatatttaattttcaaatcatcaattaagttaataattccttcatcccctaaaccatcgcattttgaaaaattgacactagcatcctgccattctggggatacaacgataaagttctcttttgcagctaattcaatccaaccagaagaatcggcttgaacccgaggatcattaccgtttccatgaagcgtaagaactaaaggaactgaatctttcttagtatcaattacttgattaggtaaatattcaaaccaagtgtattttccaggcatatttgagacagtttgattaatctcttgattatgaatgattccaaggcgatcaaaaattggcgtttcaattagtttatacggttgctcagcattagctaaatttgtatcagtaacaggcatattatagaactcggttgtttcattatgctgacgatagtttttagaaaaaactgtttcccaggcattatcgaatgcattttttaatgtttcatctgtttttgaatttaccacgatttgtaatggatttgtagaattttgatagatcgtgtagttgttaaatgattgagattggtcagtttgattagcttgtttgtaataactaacagctgatgttgctgttgaacttaaatatgctggtataggaacgttataagttaaatcgctattcattgtaccgccatataccatcattccagcaataaagtaacaattttgactaatataattattgacgaaagtggcaccctcatcaattccgatcactttaatgttgctgacaccagtgccggctaattttttgaaggctgtgacatcatcattgttatattgcgttgatataggattaataatatatactttccctgcccattcatgaacattatcgagaagaccaatttcttcaattaatttatcagcgctagtaagatcttgttttcccgcaaaaatgtaataaataggtgttaagatattactacgttttgaggtgtagccatctgcttcactatcatattcgtagtaagtataattattgattgtgtcactagttacttcagttaaaatgttttcatttgcatataattgattaactgaaattggagctgctaacattaatagtgacaatgttagtgctaataatgcttttgttatttttttcattgttccacccctgattttatatttataacttttaagttacattaaaattatacaagcgcttacaataataaaacataattatctttgaacgatcaattcaaaataaaactagtttattcaaaaactgaatgaactagtcgatgtaacgaatatacatatttctaaagattggaataaaataagtaagctggatataaccgctaatttcatcattacgctgattgccaaatttatagatataatcaaactttgcttcatcagtatgctgtgtaatacaggtaagaagaattttagggttattaagactgagtaagatatctctaatttccttagttgaaggagcattgtaccattgaccactggtactgatacaaataattagggtatcttctttcaaagacctaagattttctgccataataatgggatcgttataactataagcattgataccatattgaaccatttctaattgaactagataaatattagccaatgaaaattcagaaccaataaaaagaacctgtttataattattgattattttaactaatctttcaagtgctgtcatatcaagcttatcaatatcattaaaagcattttgtaatgattgttttacatcatttttaatttcttcgttatttttactaataatcacttttttattattaaaagcattaagtcgcagcatttgttgtccagcaatgaaatcccaacgatactcattgatatttttataaccctgattttttataaaccggctaaccgaagcttgagacaagtaattgtcaccggctagtttttcaagactgatttcattgattttatcacgattagtaaagattgctttagcaacctgagtattagttgcattattagtagttttattaagatattgaattaaaccatgaataccttctcttttcatttttatcaccaataaaagtatagcataaaaatgaaatatttaattgtttttgaataaacattattaactaggtaatattttgggtcaataattattttgaatcaacttgattattaccagttcacaagagatagtaatttcaaaagaagagtttttaatggtctgttaaaattatttcaagtgttgatggaagcccatcatcacgttcgacgaggagcttatagttagattaatgtatttagagagcttttgatataattgtttgataagagcatcatttgagctatcataaatcatatagaacagatatttatagttcaattcatttttaaacaattcaaataaatgacgtttttaatcaatttcttttatccatgatttattatttatataaacgagaacttgtttggttaaaatagattgatttaacggattatctaaattagtatcaacaggtaattgaaatagcataggcaccatcttttatatatatgcatatacgcttagaggaaactgatgattaaagcaatgattacggcacttagaacatcactgatataatgaacaccacttaagattcgtgaacagctaacgacaaatgctagaattaacatgatcgtcccaagcagtgaatttacctgaagacaagctaatgcaattgcaaaagcactgaccgtatgtcgtgaagggaaagattcaccttgcttatgttctattaaaggatcaatagccatagcttcataagggcgtttacgattaattactttgcgcaaaagtgttacaattaaaaatgaagcaagtggcttataaagtgttttagctaataatgtattttgagtataaagtaaataaacgagcaaaattgaataaacaataaaagtaataatagggatatagcgggtaaagcccataatgattttttgcagcaagggatgtttacgaatattagataacattgtttgataaaatttttccataaaaactccttattttaattgaatgatcgtttcgcctgcattcattgttaagatgcgccgaccagcacgtttatgtttatattgcttccgaataaattgttgtagtattttacttgaatagccgtgaactacagtaatttctttcgtattgggggataatgaatttagatagttatccagccggattttagcttcaatcgtagtacagccgtgaatatcgatttgattaaacataatagtctccttaaattaaagtttagttaattatactagatactttaaaattaaacaaacttgcaatttacctggatattaagtagaatataagagcatatgaatggagtgatataaatggcactgacagccggaattgtaggattgccaaatgttgggaagtcaacattgtttaatgcaataacaaatgcccaagttgaggcagcaaactatccgtttgcaacaatcgaccctaatgttggggttgtagaagtacctgattatcgtttagataagttaacagaattagttgaacctaaaaaaactgttccaactactttcggttttactgatattgctggtcttgttaaaggggcgagtcgtggtgagggtttaggaaataaatttttagggaatattcgtgaaactgatgcaatttgtgaagttgttcgctgttttagagataaggatgtaactcatgttgatggcgatgtcgatcctattagagatattgaaacaattaatttagagttgatttttgctgatttagatactgtagaaaaaagaattggacgaattggtaaaaaagcacaatcaggagacaaagaagcgaagttagaagtcgctattttagaaaaattaaaaagtacgctagaagccaataaaccagctcgagtgatcgagtttagtaaagaagaaatggatgttgttaaacaatatactttattaacaatgaaaccaatcatttatgtggcaaatctaggtgaagaagacttagaagatccaactactaatccacattataataaagtcgttgaatttgcagctggtgaaggggctgatgttgtccctatttgtgcaaaaattgaaagtgaattagttggaatggataaagaagaaaaagatttatttttacaagatttaggaattgaagaaagcggtcttgataaattgatcaaagaagcctataaactattaggacttcgtacatactttactgccggggtacaagaagtacgagcttggacttttaaagaaggtatgacagccccagaaatggcgggaattattcatagtgatttccagagaggttttattaaagcagaaacatatagttttgatgatttagtcgaatatggcagtgaacatgctttaaaagaagctggtaagattcgtcaggaaggaaaacaatatgttggtcaagatggtgacatcatgttgtttaaatttaatgtctaatggcaaaaacaaaaaagagttttattgagagaataaaaccgactggagctaaagatttaattagaaaaattattttattagtttgtatttgtgtattttgttatagtgcgtataatctagcctcaatttttcttgaatataagagcatggatgatagtaataaagaagtagaagaaacatatgttactgaaaatacagaacaaaaaaattcatataagacaattgattttgaagccttattagcaagaaattcagatgttaagggatggatcgatattcctgatactaaagttagttatccaattgttcaaggagaaactaatgatacatatattcatagtgatattgacaaaaaggaatttagagccggttcaatttttattgcaagtgaaaataaaaacccttttactgatttaaatactgttatttatggtcataatatgaaaaatggttcaatgtttaataacattaaatcatatacagaacaagattttgcagataaacacccgtatgtttatatttatttaccagatgggacagtaagtcgttataaagtagtagcagcacatattattccagaagagagtttattatataatactggaattactgatattcaagctttttatcaagagatgttaaaaactagtgatattaaggttgattttgaacaagctgcaggtaatccggtaattactttatcaacatgtacttcagctggtagtgaaagcggaaaacgtaatgttgttcatgcagtcttggatagagcaggaattgatcctaaaacggaaacaatggattaatttagacttgtggaaaatcacaagtctttttatatataatttttgcaatataaacttttatagtaaattagttatgaatggtacttgataagaagtagataattaacatatttttcttttttattacatagatttatagattataatatctatatacgtccgaatcaaagaaaaaaagggattaatttgacgaataaagttattttatgtatgataggtaaaactgttatagttgggagcaagaatatgaaagaaaaaatactcaaatttattacatcgaagttttttgtcttaggaattcaattattagctacgattgcagtagtctactttacattcaaactggatttagtgccgactaagtatttaattgctggaattgtggtattagcgttgttattagcaggattctttggaattatttatagtagtgaacaaaaaatcaaaaaaggattatcgagtaaacgaggaatagttactaaaattattagtttattgacaagtatcattttgattgctggctgtacttatatttcaagagggaataattttattgaaaatgtttctaatgccactggacaagaatatgttgtttcagtgatttcattaaagaatggtaaaattactaaattaaaagatcttgatagttccaaaaaaattggagtatcttatgaaaaggatactgttacgattgctgaagccttaaaagatcttgataccgagattggtgatcatgaatatactaagtatgataattatgcttcacttgcagatgctctttatgagggaaaagtagatgcaattgttgttggtgaacaatatcgaacgatgctgcagacaaatcatgaagaatttaatgatgttactaaggttttaaaatcatatgcttatgatgcgaaaatggaagtaacgactaaacaaacagatgttactgaaaatgctttttcaatttatgttacaggaattgatgtttatggaagtttaaaaacagtatcacgtagtgatgtaaatttaattgttacggtaaatcccaaaacaaaacaaattttgatgacaagtatacctcgtgattgtcaaattaacttgcataaaaatggaaaaatggataaattaacacatactggtatatatggaacaagtgaaacaattaatacaattcaagatttattggaaatgaaaattaattattttgcacgtactaattttagtggcatgactaatattgttgatgctttaggcggaattacagttaattcaagtgaggcttttgaaactttgcatggtaattatcaaatcactgaaggtttgaatgagatggatggtgataaagcattgtgtttcgttcgagaaagaaaaagattaaaacgtggtgattttgctcgtggtgaaaatcagcaaaaggttttaaaggcaatgcttgataaagctatgtcacctaagattattactaattttaataatattttaagtgcagttgaaggctgctttgaaacagatatgtcagataaagagattaagtcattgataaatatgcaattaaatgatatggcggattggaagatcatcaatgttcaaattgaaggtgagtatcaattaatggatgatactttttcaatgaaagggactaatagtgatgttatgattccttttgaatcacatattgaaagagtacaagaattgatcaataaagtcgaagaaggtaaagaaattaaagatagtgaattaaaaggattaactcattaaataagaggagctctttcgagctcctttgttgttttatttttttataataatggtataataagagtattaaattggagatagaagaaaatggtttttaatcgaaagtattataaattatgttttattatatatatgtttatcaatactttagcattgggctatttaggtattgagacgaactacctgtttgtgccattattgatttgggcattagtaataattgtgcatgatatttataaaaaaaagtttaaattaaaaaagaattacagtctgctaatgatcgttcaaggactgattttattgcttgctacagcgaggaatgactatagtgatttaaattcctatgttattgcagtaatgcaattagttatttatttattgatttttaataatcctgtttcaatgagcaaagatgatattgaagatgaagtacgaatgattattccactagtaaatgtattagttggtggagcttcacttatctctattggaatgtatttagtgcatttttctagtttagctaacggctggactttaggaatggtcgggaatcgtttgtttggaatttattttaatagtaatccagctgcttttttagcgtgtattacgattgttttagcgttagtcgcagcaaggcagaagtttaagggaaaatactggtatcttgcgaatattgggattcagctggtatatattcttttaacaagatgtcgtgcggcattaattattttagcaatcattatcgtcatggttggatattattttttaatacgtcgtaagccgtatagtaattttaagagattagggctggtaattagtctaattgtagttattgctggtgcaagtctagtaggtcagcgggtagttgagattgttccacagatgcagggaattgcttctaaggagacaagtcgttttcaaatggataaagttgttaaggcgggacatttattaattgctgggaattggcaagattttaatcaaggattgacaattatcgatgaggtttctaatggacgggtatcattaactaaagctgctttagaaatttggcatacggaaccagttattggaattggagcaaataattttaaaaaaataggcagtcaggaaacagatgcattggagtattgggcagttcaagttgttcatagtcataatgtttttttagaggcgttagtaactactggggtaattgggtttatattatttgttgtatttttctttaagacacttttaatgatttttaatgttttgaaaaaaagtcacggcaaagaaatatactttattgttcaaatgttcgctatgatcgttttaagtgaatttattggtagtttatctgattatggggtattctatatttattctttatcagctacattagcatggtgctttttagggtatttatacacatatcaaaatattacagaaataagtaatattgataagatttaaaggctattttggtagccttttttaattgcgcaagaatggtgcaagatgaaattaactaatgtgctatgcttagagcaggggaagtaaataagaatgaacaatgaagagcaaattaataaagtaatagattatattgaagaacatctacaggatgaaaatttaacacttactacgattgcacaggaaattggctacttaaaatatcatttgtatcgaatgtttactatgattgcaggaattacaatttatcaatagcttcaacgacgtcgttttaatgaggcagcgcggatgcttatttatgaggatattgcattgattagtggttatgatactcaacgttcattttctaaaagttttaaagcattgtttaaaatgagtcctagcagttatcgaaagcaacaaaagttattgctggtgcaactaaaattagaacttaggtcagttgggttccaattatttaactgatgaacattgtactggcgggccgatgttctttttcttttgaattatttagttgataatattgtagattataaggggtaaaaataaaaattgtttaaaaataaaagcataaacgttgacatctttcgacattggtatataatgttagcaacctaacaataggaggggaaatagtgaaagaaaagcggatcggaatagaaattaggattcttgcgaacttgatttgccggtgtttaaatgaattgggttttaatgaagagcacaatggtttaactggacctcaagggttagttttagggtatttgtatgatcatcaagataaagatatttttcaaaaagatatcgaagcaactttcaatattcgccgttcaacagcaacggggttattacaatgcttagaaggtaatggttttgtaaaacgggtaagtgttgattatgacgcacgattaaaaaagatcgttctcacgaccaaagcacatgagttcaaagagttattagaatcacatattcaaaaaatggaagaaattttggttaaagatttagaaccgcaagaggtcgatgacttaatcagaataattggtaagattaagaaaaatttagagtaggagaacaaaatggaaaagaagtattacatgggaattgacgttgggtcaactacgataaaaatttatattacggatcaggatgataattgtatctattcaaaatatgagcgacattattctgatatccaagcaacaattaaaacattaatcaatgatgttaaagaacaatttggtaatttagaagtaacggctgtgatgacaggttcaggggggttatcactttcttcatgtctagatgttaaatttgttcaagaagtaattgcctgcacaaaaacaattgaaacttatattcctgaatgtgatgttgcaattgaacttggtggagaggatgctaaaataacttattttcaaggttcactggaacaaagaatgaatggaacttgtgcagggggaactggagcttttattgaccagatggcatcattacttcaaactgatgctggaggattgaatgaattagcgaaaaattatcaaatgatttatccaattgcttcacgttgtggagtatttgcgaaaactgatgtacagcctctaattaacgaaggggcaaacaaagaggatattgcgatttcaatttttcaagcagtagtcaatcagacgatcagtggtcttgcctgtggtaaaccaatccgtggtaaagtagcttttttagggggaccgttatattttttagatcaattaagacaacgttttattgaaaccttaaatttacaagatgacgaaattatttttcctgataattctcaactgtttgttgccatgggagctactctattagcgaaagaagaagaaaagtcaacaacgattgaagcgttgattgagaaattagataatattgatgaaacaatgcttgctagcgaagatacactagacccactatttgctgatgaaaatgatcgaaatggatttagacatcgtcattatattaataaagttcgaaaaaatgatattaaggggtatgtcgggaatgtgtatttaggtttagatgttggttctacaacaactaaagcggtattgatcgatgataatgattctttattatactctttctatgattcaaatgaaggtaatccgctagatgtggtagtaaaaatagtcaaagatatttatgattttattcctcctaatgttaaattagttcgtagtggagtcactggttatggtgaagcattaatcaaggcggctcttaaagttgatatgagtgaagtggaaacgatggctcattataaggctgctacttattttaaagaagatgtaagtttcattttagatattggtggtcaagatatgaaagcaatcaagatcaaggatggaattattcaagatatcttattaaatgaggcttgttcaagtggatgtggttcatttattgagacttttgctaaatccttaggatacgaggtgagtgattttgcaaagctggcattagagtcaaaagcgccaatcgacttaggaagtcgttgtactgtatttatgaactcaaaagtaaaacaagcccaaaaagaaggggcaaaagttgaagatattagtgctggtttatcatattcagtaatcaaaaatgctctatataaagtaattaaattaagaagtaaagaagaactaggggacagtattttagtccaggggggaactttttataatgaggcagtattaagagcgttcgaaaaagaagctggtgttaatgccattcgtccagatattgctggattgatgggagcttttgggattgcccgtttagcccgagaaagttaccaaggagaaccgacaaccttattaactaaggatgaattagaaaatttcacttgtcaaagtgaaattagatattgtgaaaaatgtactaaccactgtatgttgaccgtatctacatttaatgataatagtgagtatattagtggtaaccgttgtgaacgtggagccaatataccagtttcatcaaagaaattaccaaatttatttgattacaaatatcgtcgtgtctttaactatcgttcactaactgaagatcaggctgtgcgtgggactgtgggaattcctcgagtattgaatatgtatgaaaattatccgttttggcatactttctttactaaattaggatttagagtaattctttctcctcgctcatctaaagcaatttatgaaaagggcattgaatcaattccatcagaaagtgtttgttacccagctaaattagcacatgggcatattgaagctttgattgagaaaggtataaaatatattttctatccaagtctagcttatgaacgtaaagaatttgataatgctaataatcattataattgtccggtcgttacttcatatccagaagtaattcgtaataatgttgataatctggagaatcgcagtattatctatcgaaatccatttatggacctaagcaatcgaaaaactttattcaataacttaaaggatgaattgcgggcatttaatgttaacgacaaagaattattgagtgcaattaatgatgcttatgatgaattagctaaatgtcggcaagatattcaagatcaaggagaaatggttttacaatatcttaaagataataagatgacaggaattgttttatctggacgtccatatcatgttgatccggaaatcaaccatggattagctgatttgattacagctgagggcatggcagttcttagtgaagatagtgtttgccacttagataaggatttagatcaattgcgagtagtcgatcaatggacatatcactcaagattgtatcgggctgcttcatttgtagcaactcagcctaatttagagttgattcaattgacttcatttggttgtgggctagatgctgtgactagtgatcaagttgctgatattttaaaagctcgtcataaaatctatactttgattaaaattgatgaggggagcaatcttggggcaattagaatccgaattcgttcattaaaagcaacgattgaaaaacaagctaaaaacaaaaaacagctctatccaaaatatcagcccttaaaagtaccttttactaaagagatgcgtgatcaaggttatactattttatgccctcagatgtcacctttacatttccaatttgtagagacagcaatgcaggagtctggttataatttagtggttttaccatcagttgataaaggggcagttgatgctggtttaaaatatgttaataatgatgcttgttatccaagtattttagttacgggtcaaattatggaagctttattgagtggtaagtatgatttagaaaagactgctgtaattatatcgcaaactggcggaggatgccgtgctactaattatatcgcctttatccgtaaagcattgcaagatgcaggaatgcctcaagtacctgttatttctgctaatcttcaaggtttggaaaataatcctggatttaaattaactttgccactaattaaaaaggtagtaattggggcaatgtacggtgatattttcatgcgagtattatatcgagttcgaccttatgaagtaattccaggaagtgcaaatgatttatatcaatcatgggttgaacgatgtcaagaaaatgtaaaaaatggaagtattaaacaatttagaaaaaatgtttatcaaattgttaaagaatttgatgaattaccactattagatataaaaaaaccacgggttggtttagttggtgaaatcttagtaaaatttcatccaactgcaaataatgaaattgtagaaataattgaacgtgaaggtggcgaagcagtaatgcctgatttaatagatttcttccaatattgtttctataatactgattttgaaaatgaacattttcatgcttctaaaaattctgcacgaatttgtaatttagcaattaagtttgttgatttacttcgtcatgatatgatcaaagctttaaagaaatctaatcgttttgatcctcctgcatcaatccaacatttagctaaaaaagctagttcgattgtttcgattggaaatcagacgggagaaggatggttcttaacgggtgagatgattgaactaattgaatcaggagctcctaatattgtttgtatgcagccattcggatgtttgccaaaccatgttacgggtaaaggggcaattaaagctttacgcaaagcttatcctgaaagtaatatcgtggcaatagactatgatcctggtgcaagtgaggttaatcaattaaatcgtattaaattaatgctttcaactgcatttaagaacatgaataaaaaaccagagtaatctggtttttttttgtactattttacgtatatacggatattgtacacaaatacacttgattcgttgacattgataactttattttctaaaatacatatataagaactaagttcgtatatatgaaaggagaaggaaaatgaaaatttcagattcgttaactgaaaaattattagttgtagcaagcaagattagtaatcaaaaacatatgtatgcaattaaaacagcttttacaacactgatgccggtaattattactggagctttttgtacgttgattgttaatgtagtttgttcgacggaaacaacagggattagtttagcaaaggtgcaagggttttcttggctggaaatgttcactgatctatttaatgcagcaaattatgctactttaaatttctttacaattgcagctgtcgttttaattggattagagctgggagttaaaaatggaataaaagggtttatgacgggaatagtagcggtttgtagttttgttgcatgcttaagtacaaatattgtagctacagtaggagaagagtcaattacggttgctggaattgccaaagattatacggcttctaaaggattgtttttgggaatgattattgcactgttttcggtagaactatttacaaaattatgtaaaagtaaatatttgaagattaatatgccagattcagtaccttcaaatgtagcaagcagttttaataacttatttccatttgcattgacaattattatctttgcagcgattaactatacagtggttcaattagcgggactaagtttatatgatatcatctatacttttattcaaaaaccattgcaggcagtagtacaagggttaccaggagtcttattgttaatgttagtagcacaaattttctggtgtgtaggtattcatggtaatcaaattattaaaccagtaagggacccgttattgaatgcagcaattttagctaatacggatattgttgcaaatccgaactataatccggctgatcttaatattatttctatgtcattttgggatacttatggtaatattggtggttcaggttgtgttgttggtttgttgattgcatgtttagtcttctcaaaacgtgaagattataaacaagtagctaagttgtctattgctccaaatattttcaatatttctgaaactttgcattttggtttaccaattatgcttaatccattattgatgattccttttattattaccccattagcaacaatggcatttggatatttcatgacgattattggattctcagatatattagtatatgctttcccttggacaaccccgccatttattaatgcctggatagcttcaggtggcagtattggaacagtaattacccaagcactatgtcaagcactatgtattgttatttccattgctatttatactccatttgttattatcgctaataaacaaaaggatattgtttcacaatagaaggctgaagccgcattagcggcttttcgtacatacattagagaaggaaaattaaatgaaacttaatcgtacagccttaagaacaattaaaattcttgaatatatagctaatcaaaaagatggatgtactttgttagaaataacagaagctttagatatacctaaatcaagtgcttttgatattgttaagacattactgtataaaaaatgattgtcgaggatcaaaatcatgggaaattaaaatataaaatgggaataaatgcttttattattggaagcgggaatattgagcgcttagatcttgtagaagcagccaaaaatcaattgatagaaactgctaatcattttaatgcaacggcatttcttgctatcttagataacaaaatggttacatatttatataagtatgaagcgccacatcgtatagtcactaatgctaatattggtacgagaaaaccaatctatagtacggcactaggaaaatgtttgttagcttttcaaagaaaaccagaagttattaaagatattttaaaagaaattgattttaaaccgttaacagaatatacgattactagccctcaaaagtatcttaaagaattaaaaagggttaaaaatatcggatatgcggttgattttcaggaagattctatttatcaaatttgtatagcagcacctatttttaatcacaataaaaatgtcgttgctgcaataagctgcacttttttatatgatactaatttaagaattaaagagattggtgaagaaatgaaaaggatagcactgactatttctaaaaagttaggttatatagatgatacaggcaggaggaatattcatggcaagtaaagtaaaaaagaaacaaaatttgcaaggtttaacagaacaacaaaaacatattataaaattgcggaatgaattaaacaaacctgatccccatcaagttaaagcttttacactatataaaattataacttatgtttttaatgttttatttccgccatatgcattatatagaatctggtgtaagaaatcggaattcacaaaaatagaacgctatgcccaatcagttgttgcagtgacaattttatgtatgtttgttttattgcagttagaaagatataaaattatttaatgggaaatcgttatcaatttataaaatcaagtaaagaatgttgacctccactacaaaagaaattatagtataaatagacgatattacgaatcaaattcgtaattataaatttgctaaaaattaattggtatatactaaattgatggcaatggagatggaggaaaaaatgaagctaaatcgtacattattaagagcaatagaaatattagaattactttcaagaagtaaagaagggtatactttaacggagctatcattaatatttgattatccaaagtcaagtgtttttgatatcatcaaaacattagtatataaaaatatggttgttgaagataatcaaaccggtattacaaaatataagattgggttagcatcgtttcttattggaagtagttatttaaataatatagatattgtaaatatagctaaaagtaatttaattgatttcgcaaacaagatgaatgcaacaacttttatggctgttttagatgagaatatggtgacttatatttataaatatgagtcagaaaacagtattattacaacagctaatgttggtacaagaaaatcacttcattgtgcagcattaggaaaagctatgttagcttataaaagcgaagaggaaattaataaaatcattgataagattgattttatttcatatacgtattttacaatcaaaactaaagagaaacttattgaagaattagcagaggtaaggcaacggggctatgcaaaagatgatcgagaaaacactctgcaacaaatagctgtggctgcaccactttttgatcatgaaggacatgttgttgctgccatcagttgtgttggtttttatgaaagtagtatcgatttagatgatttaggattacttattaaagatgtgggtaaacagatttcctataaattaggctataatcctcagtaaggaaggagttggtaattatgaaaatgacatttcgctggtatggaacggatgatcctgtaagtttagaatatattaaacaaattcctaatatcacaggaattgtgagtgcagtatatgatataccggtcggagaagtatggccgattgaaaagattgaaaagctaaaagccgaagtaaatttagttggcttagagctggaagttattgaaagtgttccggtgcatgaggatattaaattaaagagaaatgattatcaaaggtatatagataattataaacaaacaattagaaatcttgctaaatgcggaattaaatgcatttgttataattttatgcctgtttttgattggactagatcttctgttgatcatcaattaaatgatggttcgaaagcattagtctattacaaaaatgaagttgctcaattagacccaacgaaactatctttaccgggttgggatacttcttattcagtaatggaagtgagtgaattaattacagcatacaaagagttgggtgaggaaggattatgggaaaatcttaaatattttataaaagagatcttaccagttgctgttgagtgtgatgttaacatggccattcatcccgatgatccgccttggtctatttttgagattccacgtattattacaaatgaaaaaaatttagatagatttttatcgttatatgatgatagccatcatggcttaacgttgtgcagtggatcattagggtgtgcttcttttaatgatattccgttgttaattagaaaatatggaaaaatgagaagaattcattttgcacatattagaaatgtaaaaatattagatgatggttcttttgaagaaagtgcccactattcaagatgtgggtctttagatatggtggaaattatgcgtgcatatattgaagtaggttttgaaggatatataagaccggatcatggtcgaatgatatggggagaaactggtaaaccgggatatggtttatacgatagaggtttgggggctatgtatcttggggggattattgatgctttgaaagatgacggcgacttataattacacaggatattctaacgagtagagttacctgctctccttatcgtgctctgtagtataccacctctctttcattatagcagggggataggaagagtggaaagaactagaatgtctttcaagaaatatttgtgtccatgcgcgtagcgtggggaaatggagaaaaatatgaaaaaaacagtaaaattaccagagaattttttcttaggtgcagctgcaagtgcttggcagacagaaggctggagtgagaaaaaggagtctcaggattcttatatagatttatggtataaggaaaataaaaatgtttggcataatggttatggtcctgcggtagcgactgactattatcatcgctataaggaagatattgcttatatgaaagagattggcatgaattgttataggacatcgttaaactggtcacgatttttaacggattatgaaaatattgtagttgacgaagaatatgcgaattactatgataaaatgctggatgaattgattgctcaaggaattgaaccgatggtatgtttggaacattatgaaatacctgctgaattatttaaaaaatatgatggatttgcaagtaaacgtgtggtggaattatttgtgaaatatgctcaagaagcatttaagcgctatagtcataaagtaaaatattggtttgcttttaatgaaccggtcgtagttcaaactagaatccatcttgatgcactaagatatcctttttatcaagatagtaaagcttggatgcaatggaattataataaagctttagcgacaaatatgattatgaaagtttataaagagggtggatatcggattgccggtgggaagtttggtactattattaatgtggagacagcttatccaagagggaattctcctcgtgatttagaggcggctgataaatatgacttattttataatcgtatttttttagatccagcaatcttaggtcactatgaagagggtttctttgatttattgaagaagcatgatattttaatggaatatacccaagaagaacttgagattattcaaaataatactttggattgggtgggaattaatttatatcatccaaatcgagtaaaaggaagaacaacgatagttcatccagaagcaccatttcatccagatttttattatgaagaatttaatatgccaggaaagaaaatgaatcctcatcgaggctgggaaatctatccacaaatcatgtatgatatggccatgagaatgaagaatgattatcataatttcgaatggtttgttgccgaaagtggtatgggggtagagaatgaaaagcaatacaaaaatgaatctggtatgattcaagatgattatcgtattgaatttatctctatgcatttggattggctgcttagaggagttacagaaggctctaactgtaaaggatatatgctatgggcatttactgataatgtttcgccaatgaatgcttttaaaaatagatatggcttagttgaaattgatttagaagacaaccgaaataggcgtttaaagaaatcagcttatttctataaagaaattatagaaaaacgtagttttgaaatagaaacagatgaagaggtttataaatagttctgattttttctaagttatcagaattgaaaatacttgaagtgataaaggagaaggttatgggatttccaaagggttttttatggggtggagcaatcgctgctaaccaggctgaaggagcttatcttgaggatggcaaagggttaacgaccgttgatatgattccgcatggtgaaaagcgaatgtatgtaaaattaggtgacatgtatcctgttaagttaatagatggtgagaattatcctagccatgaggcaattgatttttatcatcgttatcaagaagatattaaactatttgcggaaatgggctttaaaacttttcgtacaagtattgcatgggctagaatttttcctcatggcgatgatgaacagcctaatgaagctggaatttcattctatcttgatttatttaaggaatgtcaaaaatacgggattgaaccattagttactttgtgccattttgatgtaccgatggggctggttgaaaaatacgggtcatggagaagtagagaaatgattgagtgctttataaggtatgcaagagtatgttttgaaagatttgatggtttagttaaatactggttaacatttaatgaaatcaatattttattacattcaccattttctggagctggaatagcatttaaaccagatgaaaatcatgaacaagtaaaatatcaagcagctcatcatgaactagttgcttcggcactggcaacaaaaatagctcatgaaataaaccctttaaatagagtaggctgtatgttagcaggaggacaattttatccatatagttgtgatcctaaagatgtttggctagcaatgaataaagatcgcgaaaatttaatgtttatcgatgttcaagccagaggatattatccaagttatgctaaaaaggtgtttaaagaaaaagatattaacatagaaatccaaactgatgacttggaaatattgaaaaaatatcctgtggattttatttcatttagttattatcagtcacgctgcgctagtgctgatcctagtcgtggtatgacggatggtaatgtagtaaagtctgttaaaaatccatatttagaaacttctgattggggctggcaaattgatcctttgggcttgagaattactttgaattatttgtatgatcgttatcaaaagccgttatttattgtagaaaatggattaggtgccaaagatactattgaagaagatggttctattctggatgattatcgaattgattatttgagaaaacatattaaggcaatgaaagatgcgattgatgacggtgttgatttaattggttatacgacttggggctgtatagatttagttgctgcttcaacgggagaaatgagtaaacgatacggttttatttatgttgataaagatgatcaaggtaatggaacgttagaaagaagaaagaaaaaatcttttaattggtataagcaggtaattgctagtaatggtgaaagattagattaaatatatttaaaagggtctgtgaagggctctttttaattacttgatttaaaagtattggcataatatgagacataattttaattcgcagataatgtatagtagtgagataatcttaaagagaagaatttaattagtttaatatactaaaatagaatgttatttgagaccaaaggggaatggattatgaatagtgcagattttttcagttagcgaaaagaaatatttttcattcatttatgcgatgtaatgagcaaagtgattttaagtatatccctaactatgcaccgtctgttattgcggaatttaatgataatcatttaataatcaaagactttaatactagaaaagatttctatgagttttgtcagtgtaaaatagatttatggaaagaaaattataatattttagatcctaaggttggtgatttaattgaaaattcgtttgtgtgatttaaataaaccattaaaaattagagaaatatctctagctttttaattaaataaaatgctctcttctaaacaacaagattatttgttctttaaaagggagcatatcacgtataagtttaaaagagtattataatcaactagttgaatctcgtcgaataacttcgactggcaaaataaattgctttttttcatcattgatagcaatatcattcattaaatctaaaagtaaactacaagctgttttagttaaagcgggaatgttctgcttgattgttgaaagtgatgggtggctggatgcagaaatgaaaatatcatcaaaaccaatgatcttaacttcatcagggactttaacattgttttctaaaagtcctacaagtaccccataagcacgccaatcattagttgcaaagacaccatcaaaaggaatattgtttttaattaattgattaattgcttctttagccccttcgtaattagcttgttcaatatccaataataattctagctgtttgttttcttgtaattgataatcttttaaagcttgacgatagcccattaaacgctgcttgttgacggataatgacttatttcgtgatacgattgcaatatttttacacccttgttgaattagttcttcagttgctaaatatccccctaaatagtgattagattcaacatagtaggcattactatgatctttgggttttcgatcaatacaaacaattgggatgtcacgagttaatgaatctgatgggattgtttcaattcctgaaatgcagatgattccgtccactaatttagaatctagtgatttgaaataagcaacttctttttcttcattttgtgaggtattacaaataaatactgaataattgtgtttaaaaaaatagttttcgatatctaatgctaactgtgaaaaccattcattatcgatgtttggaacaattaatccgattgtttttgattttgatgtccgtaagcttttggcggcaatattagcagtataaccatattctttaataattgtttcgaccttctctttagttttatcagaaaagcgaccattattgttgataactctagaaacagtggcgacagagacatcagctaacttagctatttccttaattgaaatattttttttctttaccatttttgttcccctccattttcattatagattaaaaaatagatattttcaataaaatgtaatcgcttactcacaaagaaaaaggtgaataaatacaacggcacatattgtgccatggatatatgtggaaacgtttactcaagatatatataataggagtatgaacgaaaggtaaacgtttactcaaaatataggaggattgtatggagaaactattatgtccatcaatgatgtgtgctaattttggcaatcttgaaaaggaaataaaagagttagaagaaggtgggattgatttttttcatctagatgtcatggatggtagctatgttccaaattttgggatgggtctgcaagatattgagtatatatgtaaacaagcaacgaaaccatgtgatgtgcatctaatggtcgtcaacccaagtgattatattgagaaattcgcagctttaggcgtaaagattatttatattcatccagagactgataagcatgcttgccgaacattacaaaagattaaagatgctggagcaaaagcaggaattgctttgaatccgggaacatcttttgaaacagttaaagaacttttgtatttatgtgattatgtcatgctaatgagtgttaacccaggttttgcaggacaaaaatatttagattttgtcactccaaaattccggcagtttgttgatgctgcctctaactatggcggctatcaggtaatgatcgatggtgcttgttcaccagaaaaaatcgcgatgttatcaaaggtaggcgttaaaggatttattttaggaactagtgcgttgtttggcaaagaaaaaagttataaagagattattacagaattaagaaagttataaaggaggaaggataaaatgaatattttgttagtatgtgcagctggaatgtcaacaagtctacttgtaaatcgaatgaacgaagcggctgcagcaaaaggaatcgggattaatattgaagcacatccagttgggagtatcgatcaatttggagatgctgcagatgtgattttattaggcccacaggtacgttatgaattaaagaatgttaaggctaaatatccaaataagccggttgaagttattaatatgcaagattatggaatgatgaatggtaataaggttttggatactgctttaaaattgattgaagggtaataagattaaattaaaataaattttaggaggtttattatgagttttccaaaaggttttttatggggtggttcaattagtgctgctcaaattgaaggtggttggaatgaaggtggaaaatcaccagtattagtagattattgcacagctggttcagctaaagaacgtcgtcaaatttggtatttagaccaagagggtaaaaaagtacataaagactgggaagcagttgatgaattaccagaagggtgtaagtttcagttatttgatgatttacattatactaaccatgtggctagtgatttttatcatcgttataaagaagatattgccttgttagcagaaatgggatatacaacatttaatacatctatatcatgggctcgtatttatcctcatggtattaaggggggtgttaatcaagaaggcgttgaattctatcgtagtgtttttgaagaatgtagaaagtatggtatggatccagttattacactgtataaatatgatgaacctgtttctcttcttgaacaacacggtggttggcgcaatcgggcaatgattgatgaatttgttgaatttgcacgagtttgttttactgaatataaagatttggtaaataaatggatgacatttaatgaaattaatatcattatgccattaaatgatactcctaaagataaagctaaaagagatctagcttatttgcacaatcaattggttgcggctgctagggcaactattgttgctcatgaaattgataaagatcttaaagttggtgcaatgatttgtggaaatatgaattatccacttactcctgatccaaaagatgcatttgcacaatataaacgtttccaagatttctttggatatagtgcagatactcaaataaggggagaatatccaccttatgctaaaagaatttgggaagagtggaattttactccagaaattacagaacaagataaaaaggatttaaaagaaggaaaagcagactttttaggattttcttattatgcttcgggggtaattactactcataatgaagaacaattggatattactggaggaaacattttaggaagtgttaaaaatccgtatcttgaagcaaatgcttggggttggcaaattgatccgttaggatttaaacatttcttgcacattttaaatgatcgttatcaagtaccgttatttgatgttgaaaatggtattggactgattgaaactgagggtgaagatggtatttgtcatgattcggcaagaattgattatcatcgtcgacatattcaatgcatgaaagaagcagtcgaagaaggtgtaaacctatttggttatacaacttggggatgtatcgacttagtaagtgcgggtactgggcaaatggataaaaaatatggatttatctatgttgatatggatgatcaaggaaatggtgatctacatcgctcaagaaaagattcattctattggtataagaaggtaattgccagcaatggtgaagatctagattagagtcaggagaaagttatgaaaattggaattggaaatgatcatgttgcggttgaatataaaaatgtgatcagagagtatattgaagcaaaatatggctatgaagtaatcaattatggtactgatagcagtgaaagatttaattatccagtttctggtgaagcggtcgctaatgcagttgtaaatggtgaggttgataaaggtatcgtaatctgcggaacaggcgtaggaatttctttggctgccaacaaagtaaatggaattcgctgtgtgacatgtagtgagccatattcagccaaattatcaagagagcataataatactaatatgctggcttttggcgcacgagtagtaggaattgaacttgcaaaaatgattgttgatgcctggttaactggtgagtatgaaggtgggcgtcatcaagttagaatcgatatgttgaaagaaattgaagaaagacaaaaaagtaaataactgttagtgaattgtattgtccattagtgcctccctgtactaataatctctgccattgataatataattcttagctaaaataaagtgtaatgaaaaaacaacaaatgcttttaaagctatttgttgtttttgattacgctgagaaactctggatacgataagtgagataataatttttttacatcaagttcattattagcaacatttttcagcgtattaaataaagtattatacataatattattattgtctaaacatgaaaagaggataatgacctgcatttgctgctgatcaaacaggattggttcatttaaagtaattgcgacgatattgttattggcattgattggtttatttagttttattagcccaatcacattattgaaagtgttcaaagtataacgatgctgtttatttaactcgtatttgaaagtatcttttagatttggataaagacatgttaataaatgatagaaagttgaggcgacgccctttttgcttttgactttaacattggatgaatatagatatggatgaaaataataaacaaggtcttcatcattgaataaataagataaatagcttttgattctaatgatatcatcattagtaatcatataactggtattaattacaggaatcgataattgtttacgaatcggtactgaagaaataattaagtcataattacttaagtcctcctcattgattcgataatattgagtatatttagtaataactaattgtgctgctaattcagtttcaatccgataacgatgtagtgtaaacatagaaccactcatacaattgatcaataaaacttttttctttttcttgttttgattgttaatagcattattaaagagtattgtaaatgccgataattcactacgtgataactttatcttggagtgttgttgaatcgttgctgatgcaatagatgctaaatgatatggtagaggatattcatattgaatattttcatataccggggtacggattttttcaacatatgcttgtctgatcaaagtattttcaatatatagcgataggattctaaataatttatcagtatcaaaagtaattaatgtttctgctttgattctcgctagaatttcattagcaatggtaattacattatcatcatgagaagcagataagccgcgtgatgaccttttacagattaataaaatagtaatattttgaatctcatattcattgaaatcaattttaaaacgttcttgaacatattttcctaattctttagcagtagcatattcaaaacgatccttgaattgctcgaaattagcgattgggctatcaatcgtatgattgatcgtattccttgcaatagcgatagagaaacaaattaaaaagtcaatcaaactaatatcgctcataatgatttgatgctgattaatgatctcaatgatttgataatctggagaattaaaataggcatccaagaaatcaccaaacatatctgattgtgttaagttttcaaaaacccagtcagctaagacttttctttttgaaatttcacttccttgaatactaataccgtaatttggtttttgaattaaagttaaaccatatttatgaatatctttttttaaaagaaggacatcattagcaacagttggtcgacttactaataattcattagcgaaagtttctaatttaatgtagctggcctcttcaattaatctttttgcaatataatttctacgatcttttggtaaagttggaaaaacattattttcatcacgctcattatcattaataatgttttgcaatcggcttaaatctttagaagactttccttcgataaaataaccttttgaaggcttggataataaattaaggtttaatgatgacaaaataactctaacgttactaatttcatcacgcactaaacgacgaggaattcctgtcgaggtagcgatatcgtaggttgaaatgtagtctggtgaagctaataataattgaataatttttaattcgtttttttttagtttcatatggtcactccctagtaaaactatatcaaaattagtaaaaaaagtaaacgtttactcattgttttttaagacttctattttctaaaaacattaataataccaatgggtttgaggtatttgtaaataaaaatggcataatttacgacaggataatatatcgaaaaaataagtgaatgggtatactatatagatagacaaagagaaaacgtttacatttaaagcgtttttgaaaattaagggaggaaaaaatatgtctactgaaaaaaagtccttcatggacaaagtattggaaaaagttgatgtaatcgctggaccaatgacaagatttggacaaatcccatttgtacgagcaatcgtaaatgggatggtcgcagcattaccagtaacaatggttgggtcaatcttcttagtagtatacttattctgttcagatggtggattgacaactaaagcattaattccatttttaaagccttgggctgatgatcttgcattagtcaatagtttatcaatgggaattatggctatctacattattatcgctttcgggggagaatatgcagaaattaaaggatttaataagactacaggggcagtcggagcattctttgcttttatgttattaaactatgattctgttggtaatttagtaatcactgctaaagatggaactttaagtgctggaggcagtgctttcgaaagtacttattggggtggttcaggtttgattacagcaatgatcgctggagcaattgcaattaatattattaatatatgtttaaaaaagaatattgtaatcaaattgcctgattcagtaccacctgctatctcagatagtttctcagcaattattccttatttctttattacgattgtatgttggggaattagaactttagccggaatcaatattccagtattggttggagaaatgttattaccagtcttaggagcggcagacaatgtctttgtttatagcttgcagcaattcttatcagcattgctatggatgtgtggtctacatggtgacaatattactggtgcagttactaatgtctttacaaatcaatggcttgctgataacaacactgcttttactgctggaacattagttaaagatttaccatatgtttggacaccaaacttatgtcgtctatctcaatgggtatcatcttgctggccaattttaatttacatgtttatgtctagtaagaaattacctcatttgaaaccattagcaacaatctgtttaccacctgcaattttctgtattattgaaccaattatgtttgggttaccagtagtaatgaatggtttcctattaattccatttattttaactcatacattaacaggggctttaacttattggttaactagtattggttttgtaggaaaaatgtatatgtcattgccttgggcaacaccttcaccaatcttaggttatttatctgctggtggttcagttggtggtatcattattgtatttatcaatctagcaatcggattagttatcttctatccattctggaaagcttatgaaaaagctgaagttgctaaaatgaatactgcagaggcatagaattaattaattaagaaaactttaacaagttctcttaattaaaaaataaggaggaactaattatggaatgtccatattgtcataaggaaataccacaagattcagctttctgttatcattgcggtaaagaaattagtgcagatgcacttaaacaaaaaaacaaatcaaagttaaaaaagaatccccgtgaaaatagctgggctaaattagggatcctcctattttttatcggtttaattggattggattttatcgcaggaacaatatttagtgcagttggtggaaatgtaaagattccatatattcttagttcgtttgcttatcttggggcaatcgtttgtggtgtattgtcattgcgggtagataaacaggatcgaaaaaaaggattcgaaccaaatggtaataaaaattatgcttgggtatcgatcgttattagtggttttgttagtttagttaatttttcacaagttattttgaaatagagagcaggtggatattatgtattgtcgaaaatgtggtgctgtacttaaagattctgcaaaattttgtgatagctgtggtagtgaagtaattaaagttgaacaacgtagttatgctcaaaaatataatgataataaaataaaacaaaagatgtctaaaaaagatattgaacgaatggaaaagcatcgagatgaaaaaaatccatatattggtgcagctttatttgcttcagttttagcacttattttagctatcgtaccatggaattattttggtgatggaattggaacaagtttaccaatgcgaatcgtaatcgttgtttttgctttgttaggtgattatcatgtcactaaggcaaaacaagtaaataatttaatttatagtaaatatggttttagaatcaaagctaatattgtctcattagctaattgcttatcaatctttgtaaccgtaattggtttatttgctttgtttacactataggcatattaatgcctattttttataaggagaaaaattatgggtgtattattttttaaaccgatcccacgcttggctatatggggacatacgttagttaaagattattttggctatcatgattttccggatggagttggacaggcttggtcatttagctgccaaaaaggggcttcaaatatttgtgagactgcaccatatcaaggaaaaactttattagaattatggcaggagcatcaagaattatttggtcatcctaatgaacagtttccggttattatttcgttagtaggaccagaagatgatttaagtatccaagttcatcctgatgtaaaagcggctttaaagttaggttatcaagcaggcaaaaatgaagcttggtattttattgaagctgagccaggagccaagattgtttatggacacaatgccaaagatgaagctgatttgactcactatatcaaggaagaacagtgggataaactgattcgtcatttagaagtccatcctgatgattttgtatatcttccggctggattattacatgcattaaaaaaggggagtgttgtttatgaaatccaacaggctacagatgttactttccgtttttatgattatcatcgtaaagatgcaaatggcaatgaacgtgaattgcatttaaaagaagcaattgaatgtttgtcttatgatcaaaaggagatggaaaataagcttacgactgtaatgacatcattagaaaatggtgaacaaactgtttttattgataatgactcatttactgtaacaaaactagaacttacaggggagaatcactattatcatgataattatcagttggcgacggttgtgaggggctctgggactgttgatggagtgcctattaaagtcggtgataatttcttgattccgcaaggaaacaaaattgtttttgatggtcatatgactattatgatgacaacgagataaaggagaagatcatgaaagaagaatttttatggggcggtgctttaagcaacgttcaagctgaaggcgcatatttagaagatggtaaagggttaaatgtttatgacactctagtagttactccagaacccgggattgaaccgatgttttgtgatacaaaagtagctactgatcattatcatcattatcaagaagatattgattacatggctcaaatgggatataaagcatatcgcttttcagtagtatggtcaaggattcacccgcttggtaatgaagaaagtcctaatgaagcagggttagcttattatgaaaagatggtcgactatcttttatcgaaaggaattgaaccagtagtatctttagttcattttgatatgccggattatctgttaaaaaactataatgggtttatgaacaaagaagtaattaacttttatgctcgccatgttgaagcggtagtttctagactgaaaggaaaagttaaatactggctgacatataatgaaattaatttagcttattgtcaaagtgatctggtggcaggagcttatttaccagatggaatgtctaaagcagagatgttcgtacaattaaatattaatgtacaaattgcacatgctcgtgctgtagaggtaattaaacgtgttgatccacaagccaaagtaggtggtatgattgggcatgcaccattctatccactcacttgtaaaagtagtgatattattgctgcagattttaaaaataagttacacaactattttgcttttgatacgatgtgtcaaggagaactaccagattattttaagcagtatgcactaaatagaaatataacaatcagtctaaataaagctgatgaagaggtaattaaatcagcatcgaccaaactggattatctagcattttcatattatcgcagtagtgttcaggcttcatttgatgaaattgatgatgtgattactttagaggatgctattttatttgatcagcgcaatcttaaaaatccttattatcaagcaaatgagtggggctggcaaattgattcacagggattacgatattcgttaattgatttttatcatcgatatcataaaccattgtttatcgtagaaaatggtattggaattgatgaacagttaattgatcaaaaagtatatgatgatcaacgtattgattattatcaacagcatatcaaagcaattaaacaggctgttgaacatgatggtgttgatttaattggttatttagcttggagtccaattgattttttaagtagtcataaagaaattagaaaacgttatggatttgtttatgttgatcgtgattttgaagacttaaaagatttaaaacgttatcctaaaaaatcgttttactggtataaaaaatgtattgctaccaatggtgatgatttagagaataatattgaatattaggctagagggggaataatgatgaatgtttttgttagtgtgtgcagcgggaatgtcaacaagtctattagttaatagaatgaaagaggctgccgaaacaaaagaaattgaatttcaaatcgaagcccatcccgttggacaaattgaaaaatatggtgaagcagctgatgttattttattaggaccacaagtacgttatgaattaaagaatgttaaaaaaatgtttcttgataaaccggttgaaataattaatatgcaggattatgggacaatgaatggtgctaaggtcttggatacagctttaaaattaggtggaaaataaataataaaaatggtttgtttagatagtcatgaaatctatttttccgtttaaatagctttgattgttttatttaaacagacctttttataaaaatgcgaggttaaaaatgaaatttaatgaagtgatgcatctttcattttatactgatcagatggataaaatgagagatttttatgaaaataaattaggattaaaagctaaaataattatgcgttatggggcttatcttggacaaaaaagccgtggtgcttgggctaaaaaagcaattactgatccagatgggattgcttatatttttattgagttagccccgggacaatatttggaattatttaataaagcagataaccagctagaacatgaaaagccagatgttagactagggtattcacactttgctttaatggttgatgatatttttgaagcacgaaaagagctgattgaagctggtatcgaaattgatattgagcctaataaaggtcaatcagaaacttggcaaatgtggattcatgatccggatggaaataaatttgaaattatgcagtatactgatttatctttgcagcatcaaggaaatgttggttaaataagaccctacgggagcgtaaggtcttgtttattattctttgtattttttgtaataaagtgaggtaacgagaatatctaaaatataatgtatcgataatccatatagcataatatgatggggcagatgatgtgaggatgaatcaatatacaaggcttcattgcatacaagttctaaagttgggtcgatttttcctgtaattgcgatgacacggattcgtttttttcggagttcatatgcggcatcgaccattgtttgattttttcccgagtgactaactacgaaagctaagatgtctcgaggatcgatgttatcaatataggcagtattcaaagtgttaaagcattgtgctttgataccaatggtatttagttttaaacaggcagattgaacttctgaataattattgtcattggcataaaaatcaatttgtttagcttgcagcatataatttatcgttcgaacaaacgattcaaaacgagttagttttcgagtttctttaaaaacatggtcatatattgcaggtagggtttcaattacatcacgaatagaactttttgaatcaatccgtatatttttcatttgatcatacattgttttttcttgggtgtaagtcacttgaaaatcactatagcctttaaatcctaatttttgaacaaagcgaataagggtgggggcactaactttgattaaagcagctaattctttagcgttatattgaagcacgcaatcaggctcttgttctaaatattcggaaataacttgttctttttttgtcagtttaatgctatcgattaattcacgaatcattttatgcactcctttttagggattatttatacttatattttaacatattaatagacatagagaaaacgttttctcactactaatgatatttttgaaattaaatttcataattatttatatctttgaaatttaattacaaaatatctatatatgatttttttagactactttttaaattaagatttagttgtaagaaaatagatataaggagaaaaaagatggaactacataatcaagtaactagattgattagtgcaaaagctagtaaaatttctaattatactggtagagaattaaaagaagcaatttttaaatctgaaggtagggtgctgatgggacaaacgtatttaaaaaatccaatcttatttcctaattgtaccagtaccgaattaatgtttgcttttggtgcggatatggttttattgaatggttttgatttttttcatccagctgattgtcctggcatgcaaggatttgattaccaagaattgaaggatttagtaggtggtagaccagtgggaatttatttggggtgtcctaaagaagggcttgattttaataaccaagagaattctcagttatacgatctagcaggtatggtatgtacaaaagaaaatcttttaaaggcaaaacaatggggtgtatcatttctcattttaggtggtaatccgggaagtggtacatcaattaaagatgtgattaagtggacaaaagaggctagagcgatttgtggtgatgatatgctgatttttgctggaaaatgggaggatggcattagtgaaaaagtattaggtgatccacttgctgattatgatgctaaaaatattattaagcagttgattgaggctggggctgatattattgattttcctgctccgggctcacgccacggtattacagttgagatgattcgtgaattaattgaatttacgcatcgaaatggggctcttgctatgagctttttaaatagtaatgttgaagcagcagatgttgatacaattcgtcaaataacactgatgatgaaacaaacaggatgtgatgttcatgctattggtgatggtggttttggtggtggaacctggccggaaaatatttaccaaatggcaatcactttaaaaggaaaggcgtatacttgggcgcaaatggcaacaccaagaagataaaaataaaagaaggcttaaggaggataataaagatgagttttccagataaatttttatggggcggttcgattagtgcggctcaatgtgaaggagcatgggatgaagatggtaagagtccggttcaagtagatttcggtgatcccggaacaacaactaataatcgttatattcattatttaaatgctgatggtacaagaggaaaaatgcgacaatttgatcatttaccaaagggggcaaaatatgaattatttgatgatgttagatatacaaatcatgtagggatagatttttatcatcgatataaggaagatattgccttatttgctgaacttggttttacaacttttaacacgacgatttcttgggctagaattttcccgcatggtgttgaaggtggagtaaatcaagcaggagttgaattttatcgtaatgtttttaaagaatgtaggaagtatggaattgatccagttataactttgtataaatatgatgaaccagtctatttggaagaaacctatggtgactggacaaatagagagatgattcatcagtttgttgaatttgctaaagtatgttttattgaatataaagatttagtcaataagtggttaacctttaatgaaattaacattttgcttcactttaatgttaaagaaggaaaacagtttgcttttgaagaattacataatcaaatggtagcggcggcagaagcggtaaaagcagctcatgaaatagatgaggaaatcaaagttggttgtatgattgcagggttctgctgttatccatatacgtgtgatccaaaagatgttttaggttcatataagttgtttcaagaaaaatttgcatattgtgcagatacgatggtaaggggatattatccagcttatgcaaaacgtatctggaaagataataatgtatctttagaaattagtgaagaagataagaagattctaatggaaggtaaatctgactttctagcatattcatactatatgtcaaatgtatttactacgcatgatgtagagggaaacttagcaacagcaggtggtcagggtagtttagccaatccatatttagaagcatctgattggggctggcaaattgatcctacaggttatgaatattttttacatgtactgaatgatcgatatcaagtaccgttatttgatgtggaaaatggtttgggggcacatgatcaagtggaggatgatggctctattcatgatgattatcgaattaattatcatcgcagtcatataaagagcctaatgaaagctcgtgaagagggcgttaatatttttggttatacatcatgggcaccaattgatttggtatcatttacaacaggacaaatggataagcgatatgggtttatttatgtagatatgaatgatgatggagttggtgatttacatcggataaaaaaggattcattttattggtatcaaaaagcgattaaatcggatggaaaagatctagattaagatgtctgttagagacatcttttttaagtatgacgacttgtcatacatctagggtgaaagtcctttgtgaatgtagttgtcgacgaatcacatagtgcatcggaaatgtatttgagccgaagggcatatacacttggatctaggcattagaaagcgaaaaggagaagatcacacaaattattagaggaagtcttatctaagaaaaatatgatacttgtctataaaagcacaagtagtgtggataatgtagccaatgatgaaataaaagacaaattgaaacaaggtcttacaaaccacaacctgttaaaagtattgaaattccaaagcctagtcatggtgttagaaaacttggggtaaattatggtagagcaagacaaatatcatatgctatcaattcgtgataactagaacatgtgttgtgcgtgctgtagcaaaagaaaggctagcacacaatggactagttagttgtttagattattatttattgagatataaattgaaatttaattaaactgccgtatatggaaccgtatggacagtggtgtaagagagggaaaatatttaaaattttccgctacttgattaatttaatttagtagtatgaaattaaattacagtactgtaaataaatgtatgaaattcaattgcaagagctggaaaatcactgttttataggtttttttcatcataaaataaacctataaaataggaggaaagaaagatgttaaaagttgcttatattgggtttggtaacagcgtttgtcgttatcatttaccatatgttgaaaaaagaaaagacttcattgatgtaaagtatatttatcgtttagaaacagaaattaatgaagaaaaagagagctggtatccggggattaagtttactagttcaattaatgagattatggatgatcctgatgttaacttggtagttgttaataccccagatcgttatcatgtggagtatacaatgcaggcattggatcatggtaaacatgttttatgtgaaaaaccatttgcaatgaccgctaaagaagctaaagatgtattcgattatgctaaagaaaaaggtctagtagcaatggctaaccaaaatcgtcgttatgatgctgatatgcgcacagttcgtaaagttattgaatcaggtgtacttggagacattgtggaaattgagtcacattatgattattttagaccatcaatagcaaataataaaggtatgggaattttatatgggttagcagttcatccaattgatcaaatcattggtgaattcggtaaacctaatcgagttgtatatgactgtcgtagtgttgataatcctggagtcagtgatgattattatgattttgatttcttttatgatggatttaaagcaattgttaaaactagttattatgtaaaacttgattatccacgctttatcgttcatggcaaaaaaggaagtttcttaatgccggcacttggtcataattcatcagaaaaacctaaaccaggagcgatccatgtatcatttgatccattaccagaagataaatggggaacattgtcttacattgatgataatggcaatgatattacaaaaaaagtacctacagaaattggggattatggaattatttatgacaatttaaatgatgttattgtaaatggggctcataaattagttgccgatgaggaagtaatagaagttttaaaaattatcgaagaagcaactaaagtagcaaaggaggctaaataatgaaggtcggaatcgttggggccggtatgatcgttcatgattttttaacttttgctcatgaagttactggtatggagttagttgctttatgtgccacaccggctgaaaaagaaaaaattgttgagatgtgccaagctaacaatattaaagcgcattatacaaatattgatgtaatgctggaagatagtgaggttgaagtagtttatgtagcggtgcctaatcatttacattatgaaatgtgcaaaaaggcaattttagccggtaaacatgtaatctgtgaaaaaccatttacttctaatcttaaagaattagaagaattggttgctttagcagacactaataaagttattatggttgaggcagttagtacccaatatttaccaaatactttaaaaattaaagagttattaccaacactaggacaaattaagatcgttagtgctaattattcacaatattcatcacgttatgatgcgtttaaagcaggagaagtcttgccagcatttaatccagccatgtcgggaggggcattaatggatctaaatatttataatataaatttagtagtagctttatttggtaaaccattaaatgtcaattatgaggcaaatattcaaagaggaattgatacttcaggaattttaacattagactatgatagttttaaatgtgtatgtattggagctaaagattgtaaagctcccgttgcaacaaatattcaaggtgatgcaggatgtattacaatttctacacctgctaatagcttaaatggttttaaagtattaatgaataagggtagtgctaaacaaatgaataatgaaggtgatgaggtttcttacaataatgataaacatcggatgtatcatgaatttgtagaatttgttaaaatgattgatgaaaaagattttactcgtgctaaaaaaatgcaggaaattagtttgattactattgagattgcgactaaagctcgtcaaagtgcgggaatagaatttgctgcagataaataataaaattgttaacaatatagtttataaataatataccacttgctaattataaatatccatgatgttagacatgtcgtggatattttttaaataaatgatttacaaatataaaagaggttaaaatattatttaacctctagatttatcaactatttaataataaattccggtaatgacatataaccaggagctatttcaaattgattgaaaacaacaactacctgattatctttgttgatataaaatggttgttcattagtaatctttaaattattaaccgcttcatcaaaatacattaggttaggatatttttctttattctccgcaatctgttgttgtacagattttttaacgatattttgataatctgaacctaagaaatgttcaatattgtagacttcgccagttttaagatctactgtataaaatttcttttgtaaatagctgtctgccatgatttgggtggcattaattgaaaatgatattattttatcgtcactatagtagttttggaaagtaatatctgcaattaatttatgttctgtgtttggtactttgtcaaattctttaaattcgttagtaaagtcatcaattgcctgggtaatcagcttattaataactttttttactttgtcatctttaacattaacaacatggggaatcttgacagtaacaattgtaccttcagtttcataatgtttctcttttaataattgaagtttagcattatcttcactggcatgaacagcattgatacataatggtgcaataattagtaaaaaaatcaggaaacgtttcttcatatttcatctctttctagttgataaatgtgttgatagctttgctatcattatagtttttacgataatttgataagttattcaaactaaaattttcttgttaaggaaatatgatttattaattatttttagtaatatgttgggtaataaaaagagagtacggtaaaaatagagagtaggataaagctggtaatgtttaagactgtttggaatatttttgttgtttgtttagtaaattatgttgttatatgctctttttattttgttagaatataaatatgtgaagatatgtgttttataaaaattacttgacctgaagcatacttcagcgtgtattctaaattaaaaggagggattttatgtacttatatatgggtttgcttgcggttatacccggtattatttattttactttttttattaaccgtttattacgaacgattttaaatattcatactaattggttcctcattattataattggattagtgataatggtgctatcaattccagcaatgaacacgttggagttatatggggttatttattatcatttattggttgtcatgttgttgtttgagctattaaatctaggcttaaaaagattcccgatttatcggatttcatttactactggtattttgggaatagtagttacggcgttatttttaggttatggctactataatattaaacatgttgtagctacaacatatgatctaaaaagtgataaagttgaggatcttaaaattcttgaaattgctgacttacatatgtcaacatcattaagtgttacggagctacaaaaatattgtgatgaaatgagccagctgaatgctgatttagtagttttaacaggggatatctttgatgaaaataccccattagatgatatggttaatgctagtaaggcgctagcatcgatcaataatcaacaaggaatctactatgtttatggtaatcatgacaatggctctcatgcttttagcgatagtgaatttggtcctgaagatgttcgtgctacgttggagaaaaatggaatcgttgtattggaagatgcagtagttagcttagacaatataaatattattggtcgaaaagatgcaagtttttggggtacaaatcctcgtttgtcaactagtcaattattagagatgattcctgaaaataaacgtggtaactacacgatcatgctcgatcatcagcctttaaaccttgatgaaaatgcagctctaggaattgatttacaattatctgggcatactcatggtggacaattgttccctatgggaattgttcagtcattgacaagtgatacgttgattcgtggacaaagggatattggtgattttacagcaattacgacgacaggaatagcgggatggcgttatccaatcaaaacaggtgctcctagtgagtatgtaattataaatataaaataaaagacctccaaactgaaatgaatcccattatttaggtgtctaatctaaataatggtggttcacttcaaatcggaggttttattattttgaaataatttcaataccatcttcagtcactaacaacgtatgctcccattgtgctgaaagtgattcatcatcagtataaacagtccattcatctgactcatcaacatatacttcacgaccaccaagatttaacattggttcaattgtaaagaccattcctgggacaagggtaacagtaggcacatttggctcaaaatggaaaacataaggatcttcatgaatcgctaaaccaacaccatgaccacaaaattctctaacaacactataacccatagctttagcaaatgtttcgattgctttaccaatgtcgccaacacaactttgataggggataacactagccataccgagttctaaagccttttttgtatcgctgactagttttttagcttcattagaaactttaccaatcataaacattctagaagcgtcggcataataaccattcagcatggttgtagcatcaacatttacaatatcaccttcttgtaaaatagtttgctcattaggaataccatgacaaacaacatcgttgatcgagacacaaatatgttttggataacccatatattgataatcagcacaaactgctccatatttggcagtatattcctttgccataacatcaatttcttcagttgtcattccaactttgatatttgcttcaatatagtctaataaacctgagtttattactgcggcttttttaattccctcaatttgctcaggcgtctttatcattttatgggttggaattttttttccttgctgctttaattgctctaatttttcatcaaatgctagatggcattttttgtattttttttggctgccgcaccagcataaatcatttcggtttaatttcatattttgccttctttctatatgaatctagtataacacgttattctttaatttccaaagaaattacttagcctatgctaactgttgattaataattctttttctttacgtgtcatttgcttaatagcgtattcccgtttcaacgcaaggcttttttcagtatactcctcaaagtaaaccagttcaacggggcgacgagctttggtatattttgcacctttgccatgattatgagcattgattcgctttactagatcagttgtccagcctgtatagaaagtattatcctgacatttgacgatatagacgtagtttgttttcattatttcacccttacttttattgtttatattataactaattatatgaataatggtaagttttagatgacgtgtcaagaaaattagtttaagatatcttcaaagaggtgttattgtggttgattttaataatttaatggatttacaatttgaaatatttattttaatgataattggatatattttaagaaagacaaatattatttctaaagagcatcgaaagagcttgacggatttagtaatatatattgtactgccggctaatattatttactcttttatgattaaaatggatactcaaatcatcaagagtggtctaacaattttgattgtttcgattattattcagtttgcttgccaagtatttggaaagtatttctttattaaggcaacaaaacgacaacaaagtgttttacaatacggaacgatctgctccaatgctggatttatgggctcacccttgattcaaggcctttatggattagatggattattatttgcttccatttatttaattccccaaagaattgtaatgtggtctggtggggttgcatgttttactaatgctaaaggtaaagatgttattaagaaagtaattacacatccttgtattatcgcagtatttattggcctgtttattatgattagccaaattcaattaccaagttttttaaaagtatcaatccagtcacttagtaattgtacgatggctttatcaatgattgtaataggtggaatcttggcagaaatcaaaattagagatgttataaatagattgaccctctactatagttttatccgtttgattttaattcctttattggtcttatttagttgtgcaatagttaatctaccaccattagtaactgcagtagcaacagttttggcgggaatgccagcaggaagtacgacagcaattttggctgagaagtatgatggagattcaaatttggcagtagaaattgtctttttatcaacagcgctatcattatttacaattccgttattatgtttggttattaatatggttgtttaaaatcatcttttcaattatcgtaaaaaatataattaatgattagaatatagtacaatatgatatatcaaagtagaaggagaagattatgttaacaatgggatttattggcaatggtaaaagtactaatcgttatcaattgccatttgtactgacaagaaaaaatattaaagtaaaaactatttatgctcgaaatttaaataaacatgattggtcacgtgttgcaggaataaattatactgatgatttagatagtctattaaacgatccagagattcagctgattagtgtttgcactcgtcatgatagtcattatgagtatgctagaatggttttagaacatggtaaaaattgtttggttgaaaagccttttatgaaaaatagtgctgaagctaaagaaatatttgcattagctaaagaaaaagggttattagtgcaatgctatcaaaaccgtcgttatgattctgattttttaacagttcaaaaagtgatcgaaagtggaaaattaggtaatttattagaagtagaaatgcattatgactattatcgtccggaaataccactaaatgttcatgaatatgttgggtacaatggatatttatatggtcatggatgtcatactttagatcaagtaatttcttattttggtaaacctgaaaagattcattatgatgtaagacaattattaggatcaggacgaatgaatgattattttgatttggatctatattatggaacacttaaagtttcagtaaagtcaagttattttagagtaaaagaacgtcctagttttgttgtttatggtgataaaggatgctttgttaaagcgacaaaagatcgtcaagaagaacacctcaagttattttatatgccggggtcaccaaattttggaattgatcgtcctgaagattatggaacgttatcgtattatgatgatgcaggtgtttttcatgaagaaaaagtcatctctgaagtaggggattatggaaatgtttttgatggcttatatgaaagtattattgagggtaaggaacctcgggtcaaagatgaacaaactttattgcaaatggaaatattagaaaccggagttaaaatgtgtaagtaagaagatacgacagtatctttttatttttgataaaaattatttatattatttggctgattgactctaaataggggcatggtacaatataattaatagggggtgaggtacaatgagatgtgataattgcggaaatgagtataaaaatagtttaaaatgtccgttatgtggtcatcgtcaggggaagataagtcattgctcagtttgtggagcggcaatacattttggtcaaccacgatgccctaattgtgggaatccaacaaagtatgaaaagaagactgatgtcactaagaagtacgccagtagttttaacataaataattcaacaaataataaagactgcgataaacatagtgaaaaaagccatgtttaccaccaacaagagatgtatgattacaaatcaagcaataatgaaatcaaacaacgtttagaagaagctagacagcgaattaacagcatgggctttccaatcataaaaaagaaggctgctaataatgaagaaaaactaagaaatattatagttggaattgtagtgatattgattgcaggagtaactattttcgggcaaatttttaaaaattcgaatgatcaacgggattatcaagaattatcaacattacaattatttgatagtaatagcagtataacgcaagagggaaatttaaaaaatggtggttatgcttttttaacggattcaaatatttattttgggatggattatcaaatatatcaaacagaacggaattttagtaactttaaatcgcttgtagatgacggagaaaggtatatttatagtactgatgactatctttactatgaacagtatggaagatatgcacgttatgatatgaaaagtggtgaattgacagccctttttgaaatggataatgtattaccaatagataaaaataagttcctatatactaagtatgatgaagagggactgtttatatatgatgaggtaagtgcaacatcaataaaaatcataagcgatgaaatttcagattatagttatgacatgcaagatagtttagttttttatacaacaattgaacatgattatattcaggctattgatttggccggaaataaattatcacaatttaatttatctagtactgggaaaatttatgtgagtggagatttgctttattatcaagattatcaaggcgtacattgttatagtattgctgatgaaaatgatgaactgcttgttgaaggtgaggttaataattatatcgttacaaataatacaattgtatatactaactatgatgatgatttaatgactagtgatgggcatattgtatcgattgattatgatgtaactgtatttaatgtaataggcaattatattgtgtatagtacaggaaatggtgatgagtatttaaagcagtggtatataaatgatttttatgatacggctatcgctaaattgaataataatgaagaagaatagactaagcttattgaagcgaagtcttttcttttacgctaataacacgcttttttttactttggtgatatggtaaaatgtaggcattaaagtaggtgactaaatggaaaagattaaaagatgtagaaaatgtggagcgcgattattagaacatgaaaaaagatgtcctgtttgcggaacgccggtagggttagataaagaagtagatattataaaggaagaacagattattgaacctgaaaaagtcgatgagtttattgcagctgataagactgaacaaacattgcttaagtctaatgaatcagcgcaaaattattggcgtagtaagaaaatttgggctgtttttattgttttaattgtagtgacgacagtaatgcgtcaatatgttattaataatccgattaagctggcagagaatgataattcaaacacaatcactaatgattatagtgatagtaaaatatcaatcaataaaaatacaggtaaatatagtcaagcgacaaatattaattatttagggattagttatgttaatgataatgctgtttatttaatgatgaattctgaattattgaaatatgatcgtagttttaataatcgcgaacttgttttggaacaagcagttactgtttttagtgaagatgagcagtggtattattatcttgatgaaaataatgattatattcgaatggataaaaagacaaaagcagaagatattttattaaagaatgtatattatgtacataatcttggtgataaagtctattatcaaaatgatagtgatggtgaaacaattcattgtcttgaattagagacaaatcaggatcataagattagtgatgaggtttcttatagtattgttgttgatgaggaaaaaggtagaattttttatattaataaaaataatgaattagtttcgattgcattggatggcagcgacaagaagaatcttgccaataatactaatgtttatacttatgatggtgaatatttatattatataaataatgatgggctagttaaaagtgatttagaaggacaaagtaaagttatttatgaaagtaataatttatcattagtgaacctggttgagaagaaattagttattcaagataagaatattatttatacgatggatcttgatggaaaagataaaaagaagttatatacgatggatattggaggcagtctgacatttgaggttgtaggtgataagctgctggtgttaactaaaggaaactcagatagtgtgattggatatgaaattgttggtcttgatgggaagcgccatattttagatgatgaaaatcaaccaacgattaaaggtaatgagttctagggggatgaaatgaaagtaagtgagatagtaattgctaccggtgggaaacttattagtggtgatgaaacaatggaaataacaggttttagccaagatagtcgtcaagctgaggtcgggatgatgtatattccaattattggtgaacgctatgatggccatgattttattgaaagtgcatttacaaatggtgccagcgctataattactgatcggttgattgaagatgataagcatgttgttatcttagtagataatacgttaaaagctttgcaaaagatggctcattatttacggaaacatcgcaaggtcaaagttgttggaattactgggagcgtgggtaaaacaagcacacgtgatatggtttatagtgttgttaaacagcagtataagacattgaaaacagaaggtaattataataataatattggcttgccattgacaatcttgagattaaaagatgaggaagtgatgattttagaaatgggtatgaatcatcttaatgaaatggaagaattatcacgaattgcttgtccggatattagcgcgattactaatgttggaacagcacatattggagaattaggaagtcgtgaaaatattctaaaagcaaaattagaaattgttgcgggaatgagtgatggcagtacattagtaattaatggtgataatgatatgctgtcaacggttcgatttgataatttcaaggttgttaaagtcggtgttgattgcgctgctgcttttaaagctgaaaaagttattttaatggatgatcatagtgaatttacaatcaattataatgggaaggtctatcaagttgttgtcccagtaccggggaatcattttgttttaaatgctcttgttgcgattgcgattggaataaatctagaaattccaatggaaaaatgtattcaaggaattagtcaatttgaattaactaaaaaacggatggatgtaattgaattaaaaaacaacattaccttgattgatggcacatataatgctagtgaagattcaatgaaatcaagtattgacgtattggctacgtattcgcgtagaaaaatagctgtattagcggatatgttagaattgggcgaattcagcgagcaattgcatcgaagtgttggtaaatatgtagcggaaaaacaaattgatgtgttagttgcggttggccgagaagctaagtttatgagcgatagtgctgctttgtcagggatggcagagatttattattgtaatgataatcaagaagtggtaaattatttaaagaataatttacaaaatgatgacgttgtcttattgaagggctcaaatggaatgaaattaaaagacgttgtcaccaaaatagaggagaaattttcatgaaacaaaaattattggttttatgtgggggacaatcaagtgagcatattgtttcaagaatgtcttgtacatcggtattaaacaatttggatgcgaataaatacgaaatcaccttagttgggattgatttagatggtggttggcattatcttgatgcgaagcagacagatttagctaaaaatacttggttagataacagtagcatggttgaagatgtttatggattattaaaaaatcaagatgtagcatttccagtattacatggaatgtatggtgaagacggaacaattcaaggtttatttgaattggcaaaattaccttatgttggctgtcgggtgatgggctctagtgtagcaatggataaaatctatacaaaaaagattttagatacagtaggtgttccgcaagttaaatcagtatatgtgaaaaaacgttatgacgaaaaattagttgtagtaacaaatacttttgatgagattgaagaaattgaagactatattgttagagaattaggaatgccttgctttattaaggctagtcgttcaggttcaagtgttggatgttatcgttgtgataatcagactgaattgattgggaaattaagtgaggcagctaaatatgatcgtcatgtcgtagttgaggagtgcatagactgtattgagttagaaacagctgtattaggtaatgatgatgtaattgtttcacgagtcggtcaaatcatgcctcatggtgagttttatacgtttgaatcgaaatatgaagatgaagaaagtaaaacgtgtattccggctctggtagatgagcaaatccaagaacaaattcgtcaatatgcaattaaagtttttaaagctgttgatggtcatggcttaagccgagttgattttttcttagataaaaaaactaataaaatttatttgaatgaaattaatacaatgccaggatttactaagatttcaatgtatccacaattaatgaatgatttcgggatcacttatccggaattattggatcgcttgattgtcttggccttacaaaaataagaacttgttttgaactgaacttctcaagtaggacagtttataaatagtttctaattagaggattgtcacctgtaattcacaggtgacaatccttttaattacctgttcaaattgaaaatttgaacatatagacttaagtcagttgagcatacgaagtatgcgaaataaaaaaccacctgctatgcgggtggagcaataaagaagttatacaaagatatcacctttccgatataatggagttgttcaagctgtcattataagaaaggaaaggtgattaagtatggcacaaaaaacaaattcattggcacatacgaagtggatgtgtaaatatcacatcgtcttcacaccaaagtatagacgaaaagtgatatataatcaacttagaaatgatataagagaaataataataagattatgtcaatatagaggggtggaaattatagaggggcatttgatgtcagatcatgtacacatgttggtaatgataccaccaaagttaagtgtatcatcatttatggggtatttgaaaggtaagtcagcattaatgatatttgatcgacatgcaaatttgaaatataaatatggaaatagacatttttggtcagaaggatattatgtgagtacagtaggactaaatgatcaaacagtcgcaaaatatataagggaacaagagggacatgatatagcaatggataaattgagtgtaaaagaatatcaaaatccatttgaagataaagaaatgaagaaagaaaacaaaaaagagagaagaagataacaaaaggagaaaggaggaaataaatccctttgagggatggcgagagtcaaaagcgatagcttgaacgaagagaaagcagcgccttgagacgcgagcaagcaacataggcttatagcctcagagaaaaccacgtcttttaggcgtggtttttatttagttcttttttataaataatttcaataattgttgctcgtgacgtaaggtcatgaactataatgtttatagaggtgatgatatgaatgaggactacttaacaattggagaattagcacaaaagatggatgtaacagttcgtacactacaatattatgatcgtgaggggttgttgaaaccagcagcaattagcaaagggggaagacggctctattcaactaaagatattgttaaattgcatcaaattttatcatttaaatatcttggtttttcacttgtagaaattaaaactaaattatttaatctcgacacaccacaggaagttgcagcgattttaaatcaacaaaaaagtgtgattcaagaacaaattgctaacttatcagaagctttagaagcaacgattgccttatctcgagaagttcaagaaatgaatacggtagattttaaaaaatatgctgaaataatagagttacttcgtttgggaaataaagaatattgggtgtggaaacattttgataatacaattacagatcatattaaagaacgatttggtgatgatccagaggccgggttaagaatatttagcacttatcaagaagtcttagataagctgtatgtgttaaagaaacggggggtaagtcctgatagtccagaatgctttatgattgccaaacagtggtgggaaatgattttagaatttactggaggtaatttagaactgttgccagagttacaaaaatttaatgataaaaagaacgattggaataatgatctggcagttaaacaaaaagaagtagataattatctaactgcggctctagaatattattttaagaggatccaaaaggagcaagagtaatatggatattgcattgcagattaataatcttagtaaggcttatggtaaacatcaggttttagaaaatattagttttactgttgttaaaggggaaatatttgctttacttggcacaaacggtgcggggaaaacaacgacattagaatgtttagaggggattcgacgatacgatacaggtaaaattttaataaatggtaagctgggggttcaactgcaatcatcatcattaccagcggatattaccgctaaagaagcaatcatgttatttgcaaaatggcaagatcttgaggtgactgacgattattttatttatttaggaattaaagcttttctaaaaaagcaatatcaccagttatcgacaggacaaaagcgtcgtttacatcttgcaattgcgctattaggacaccccgatattattgtacttgatgagccaactgctggacttgatgttgagggacgtaacagtatccaccaggaaattaaacgactaaaaacccaaggtaaaacaattttattagcgagtcatgatatgaccgaggttgaagagttgtgtgatcgaatcggagtattaaatcatgggaaaattgtttttattggggctcctgatcaattgcatcaaacaatgcaaagtaaatttaaattaaaggttcgtttttcaaaggtgccccgattaaatgagcagtttgaaatagtttctcaggaacaggagtattatatctttgagactacaaacttagagataacattaaaagcaattattcaattaaccgaggaacaaagtattaaaattatggaaataaatactgttcagccaaagctggaagaaagatttttaaaagaggtgcaatcatgagggctttcatctatcaaattggattaaactggaaattaaatcttcgcagtaaagaattattagttcattattatgtggttcccttagtcttttatttgtttattgggggggtttttatatcgattttgcccgatgctgataaaacgataattcaagtaatgagtgtttttgctattaccatgggtggagtcttaggttctccatatccgttagtggaattttatcatagtgacataaaaaaggcttatcaggtaggaaagattcctttatggacgattgccgcaagtaattttatttctgggattatgcatttatttgtgatgagtttgataattttaataagtgccccgattatttttaaagcacaaatacctgaaaatatttttatatatttattgggggtaattttatttatcatagttagtttgagtattggaatggtttttggtgtatttttcaaaagtgcagcgaaaatgggaatggcaacgcaactagtttttttaccgtcgatcatgttatcaggaataatgttccctgtagcaatgctccctaacgtattacaggtgataggcagaattttaccggccacatggggatttgaattaatgtgtacaaatgattttttgtggcttaatgtggctgttcagttaataatttttatgataatgctaattgtagcaagtttcaagatcaagcagataagaaaagaagattaaaaaagcctaaattagtacaagctgatttagtgctttttattgtttaaactgttgatcaatcacattgttaaaactattggtaatgaagtctttagttaatccttttgaataacgattatgacttttttctaatttttcattatatttatctataggcaccaatttaaaattttcaaatttttgatcataatagttgatgactgggagagaattaatatttttaattatggtagaattattattcttttcaaaagttatttgcaggatcattgaaacattatatgcattggcaaattctggtgttgctctagttacctgattatcagctgaaataaatgatcctaatgaatatacaacaagtgttttatggttggtagtttctaaccattcaattggctgaatataatgtgaatgatgaccgataatgacatcaacccctaattcgtttagataattagctaattctttttgttcactattgacagcatatgtaaactcattgccccaatgaacactaacgataactatatcactaagctgttttgcttgtgcaacttcttgttttatgatttctttattagcgttatcgagtttcatagtgtcaaggttgcgataataaccaatcagttctctgttttgattatcaggcttattagttttataagtgtagccaagaaaactgaaggttatatcatttatggtttttgtagggatttgtgtttggacttcttttgattcatagattccggttgttagaatctggtgttttttaaagaagcttaatgtattgatacgtccttgaggacccgcgtcgttagcatgattattagcaagattaacagcatcgacacccatagcgataacttgattcccaatttcctcaggagcattaaaactataaccagttccggatactcctaattctttgccgccgatagggacttccatattggctaatgttagatcgtcatttaaaaaatatggttttactaagtcataatagcctttatcattgtaacttgttccaatccaatcatagtatggctgttcatataataaatcgccgataaaagatgcattaactattcttggccttttagtagaagtggatttgtttggtgatttgattgatgtttcttttctattgataaataaatacgtccccgttacgagggataaaagcaggagaaaattaagaaatattttaattggacgttttagttttaattttttctttgacatttttatcaccctttatattgtaacatgatcaatcatgctaattgtcttaaataagctgaaaaatctttgcatattcttaagataaattatagaagatttggtagttagatttatttagtttagtagaatgtatgcaaggacattgaggaggaatgaaagatgactaatgagattaagctggaagttacctgtgttcattgcttaggggttggggaaaaacagttatatccaataattaatagacaagatttagaggcaaaacagaatatttttgaagaagatttgtttttatatcgttgtccgcattgtggacattatcaaaggatttcgtatgaatgtatgtattatgatgagaaattaaaatatgcggtggtgttgagccatgatggacaccgttttttaaagaaagtgaaaatagatttaaccgcttatcaacttcgttttgtaaaaagtgtaagtgaattaaaagaaaaaatcgttattaaagaaaatggtttagatgatcgaattgttgagataatgaaacataatattcaaactactttaaggagcaaagcgtcttatcaattggtattaagagatggacaaggactagagtttgttttattatatccagataatgaagttattaagatatttatgtttaataagcaagattatttgactttaacaaagaagtataatcgttgtttggctaatgattatatggtagataggctctttgcttctagaacggttttacgtctaaataagttcaataatttgaaactaaattgtcattagaataaatagatgatattggtaaaatacttgataaaatcaggacttttatattgaatcgacttgtgaaataattaattattaatcagataattaattatctataaaatttatgaaaaagggttgacttcgacaaaattacgggctattatattcagtaacataacttaaatactttgataggaactagtaaataaatttatcgagcatagagagattctgggtggtgaaaagaattgttgatgatttgttgaactcatccttgagtggagcgctgaatcaagtaggtggctacggagtgcaaccgttatctagcaaaagtatgaactatatataatagcgtacttggtgagattaatatcgtgaggtattaataaattgaggtggaaccacggggttactatactctcgtcctcaaaatgacatagtctgtcattttgagtgcgagagtttttttataagtatttattatgcaaaagggaggaagaaaaaatgatgaattatcaaaagtataagagatttgaaccaatcaactttaaagaacgtacttggccggataaacaaattgaaaaagcgcctacttgggtctctgtagatttacgtgatggcaatcaggcgttgattacccctatgaaaatcgaagaaaaagtcgaaatgtttcaacttttagttgatatggggtttaaagaaatagaagttggttttccttcttctagtcaaattgaatatgattttttaagaattttgattgatgaaaatttaattcctgatgatgtgactgttcaagttctaactcaagcacgtgaacatttaattagaaagacttttgaatcattaaaaggattaaagagagcaatcgttcatgtttataattcaacttcagtattacaacgtgatgtcgtctttaatcgaagtaaagaagaaattaaacagattgcagtcgatggtgttaaattagtcaaagaattaagtagagaatttgatggggaagtaattcttgaatattcaccagaaagttttactggaactgaactggaatatgccttagaagtttgtgaagcggtgatggatgaatggggcgctactaaagataataaagtaattatcaatttaccgtcaacagtagaaatggcaacacctaatgtgtatgctgatcaaattgaatggatgtgtactcactttagtgatcgtgatcgtgtcattgtatcgttgcatactcacaatgatcgtggttgtggtgtagcggctactgaattaggaattatggcaggagctgatcgtgttgaaggaacactatttggtaatggtgaaagaacaggaaatcttgatattgtcgtagtagccttaaatatgtttacccaaggaattgatccaaaactagatatgagcaatatcaataatataaaacatgtttatgaaaaagtaacgaaaatggaaatcccacctcgtcaaccatatgtaggaaagttagtgtttaccgcattttcaggtagtcaccaagatgcaattaataaaggaactcatgcaatgcatgaacgtgacagtcaaatttgggaagtaccttatttgccgattgatcctagtgatctaggccgccaatatgaaccgattgtgcgtattaattcacaatctggtaaaggtggtgtagcatatgtaatggaaagtatgtatggtttccatttaccaaaaggattacaagtagattttgctaaagtaattcaagatataagtgaagaagaaggagaagtttctccagaaagagtctacgatacattcattgaagaatatgtagatattgatgaaccttatcgctttattaaacaaaagctgattgatataagtgaagatgatagtgagtttgaacgtcgtgctgagattacgattgaggcgcatggtgaagttacaactttaacaggatatggtaatggaccaatcgatgctgttaaaaatgctttaaactcacttccagaaatgcattcacacttattagattatagtgaacatgcattaacttcaggatcaagctcaaaagcagcggcttatgtttatttaagagctaagggaagtgctagacaagaatacggagtggggattcatccaaatattacaactgcaactgtaaaagcgataatatctggaatgaatcgtctgtataagacgctaaaataagtggaaaggagccgaacatgaatcgtttagtattatcgttattagtggaaaataacccaggtgtattaagcagagtggctggtttatttagtcgtcgtggttatggaattgaaagtttaagcgttggcaagaccaatgaacctaatgtttcacgcatgacggttgtggctgttggtgatgaattgattttaaatcaaattgaaaaacagttaggtaaactagtcgaagtaattgaaattttcccattgaaaccggaagaatcggtataccgggaattagttttagttaaagttgaggctgatgaaaaacaacgttcgtcacttgtttccattgccgatatctttagagcacggattattgatgttgcaccagcatcattagtaatcgaggtaacaggagatcagtcaaagattgatggactgcttgccatgttagaaggtttcaatgttgttgagatggttagaaccggattatctggtatcaaacgtggtcttggcgaaattgatatagaaagtcataacaaatagaaatagggggattagaaaaaatggctaaaattttttatgaatcagattgtgatttatctttattagacggtaaaactgttgccgtgatcgggtatggttctcaaggacatgctcatgcattaaatatgaaagaatcaggagtaaacgtaattatcggtttatatgaaggttctaaatcttggaaaaaagctgaagaacaaggttttgaagtttatacttctgctgaagcagctaaaaaagctgacatcatcatgattttgatcaatgatgaattacaagctaaattatacaaagaatcaattgaaccaaacttagaagaaggaaatatgttaatgtttgctcatggtttcaatattcattttggacaaatcgtaccacctaagaatgttgatgtaactatggttgcaccaaaaggacctggacatacagtacgtagtgagtaccaagttggtaaaggtgtaccttgcttagtcgctgttgaacaagatgctactggtcgtgctcaagatgttgctttagcatatgctttagctatcggtggagcaagagctggagttcttgaaactgattttagaacagaaacagaaactgatttatttggtgaacaagcagtattatgtggtggagtttgtgctttaatgcaagctggttttgaaacattagttgaagctgggtatgatccaagaaatgcttatttcgaatgtatccatgaaatgaaattaatcgttgatttaatttaccaatcaggttttgcaggaatgagatattcaatttcaaatactgctgaatatggtgattatattacaggaccaaaaattatcacagaagatactaaaaaagcaatgaaaaaggtattacaagatattcaagatggtacatttgctaaagacttcttattagatatgtctgaagctggtggacaagctcatttcaaagcaatgagaaaattagcaagcgaacatatttctgaaaaaactggggaagatgtaagaaaattatacgcttggtctgatgaagataaattaatcaataactaatttattataacaacacacttttgtgtgttgtaattaaggagtaatttcttactccctaattacaacctacaaaggtaaagataagggggaatataaaagtggcaatgacaatgacacaaaaaatattagcaaaacatgcaggattagacgcagttgtggcggggcagctaatcgaagcaaaacttgatgttgtaatggctaacgacatcacaggaccgatggcattaccaatttttcatcaaatggctgacaaagtctttgataaagataaggtgattttagttcctgatcattttacaccaaataaagatattaagtcggctgaaaactctaaagcaattttagatttttcaaatgatcaatgtttaactcatcatatggaacaaggtaaatgtggggttgaacatgcaattttaccagaaaaaggaattgttgtcgctggtgaatgtatcattggggctgattcacatacatgtacttatggcgctttaggagctttttcaactggtgttggaactactgatattgcaacaggaatggcaactggtgaattatggtttaaagtgcctagtgcaatcaaatttgtcttaaccggaaagcctagtcaatttgttagtggtaaagatattattttggatattattactcgtattggagttgatggggcccgttataaaagtatggaatttgttggtgaaggaattcaacacttaacaatggatgatcgttttacgatttgtaatatggcaattgaagctggggctaaaaacgggatttttcctgttgatgagcaaacgattgcttatatggaaaaacactcagtgaaagaatatactgtctatgaagctgatgaggatgctgaatatgatgaagtgattgaaatagatttaggtaaagttagaccaacagtagctttcccacatttaccagggaatgggcatacgattgatgaaattgaagcaatggataagattatgatcgatcaagtcgtaattggttcatgtacgaatgggcgtttgtctgatttacgtaaagcggcagcaatccttaagggaaaacaagtagctaaaaatgttcgtgtaatggttgttccagcgactcagaaaatctttgttcaatgtattcatgaaggtttagcagaaatttttgttgaagctggatgtgcatttaataccccaagctgtggaccttgtatgggtggacatatgggagttatggctaaaggtgaaaagtgtgtttctacaactaaccgcaattttgttggtcgaatgggcgacacagaagcgttaatttacttagcttctccagaagtagcagccgcaagtgcaattgcgggatatattgcaaatcctgaaaaagtaggtgaagaataatgaaaatatataaatatggtgataatgttgatacggatgtaattattccagcacgttatttaaattcatttgatgctaaagaattagctagtcatgcgatggtggatattgatcctgattttgctaaaacggttgaatcgggtgatattattgttgctggaaaaaattttggttgcggttcttcaagagaacatgctccgctatgtttaaaaacagcaggaactaaatgcgtcattgcagaaagttttgctcgtattttctatcgtaattcaattaatattggatttccaatcatggaatgtccagaagcagtagcaggaattaatcaaggtgatgaagttacagtagattttaccactggtttaattactaatattacaaaaggtgaaacttatcaaagtcaacctttcccagagttcttacaaaagatgattgaattagatggtttagtcaactatgttaatagtaaaaaggggtaaggataatggaaaaaaatattgctgtaataaaaggtgatggaatcggaccggaaattgtaactgaagcgatgaaagttttagatgctatcgctgataaatataatcataaatttaattatactcaaattttaatgggtggtgcttcaatcgatgttcatggcgttcctctaactgatgaggcgttggcgattgctaaaaatagtgatagtgttttacttgggtcaattggtggtgataccacaacatcaccttggtataaattagaacctaatcttcgtcctgaagcggggttattgaaaattcgtaaagagttaggattgtttgctaatttaagaccggcggtcttatatgatgaattaaagggtgcttgtcctttgaaggaagaattaactgagggtgggtttgacatgatgatcatgcgtgaacttaccggcgggttatattttggtgaacgttcaacgaaagaagaaaatggtgaattagtggctcgagatgcaatgagttatagtgagactgaaattagaagaattgctaaaagagcgtttgatattgctatgaaacgtaataaaaaagtcacgagtgttgataaagctaatgttattgatacttcaagattatggcgtaaagttgtaagtgaagttgcaaaagattatcctgaagttgtgctggagcatatgttagttgataactgtgcaatgcaactggtaaaggatccaaaacaatttgatgttattttgacggagaatatgtttggggatattctaagtgatgaggctagtatggtaacaggttcgattgggatgctggcaagtgcatcactacgtgttgataaatttggaatgtacgaaccaagtcatggtagtgcgcctgatattgctggtaaaaatattgctaatccaattgctactattttatcagctgcaatgatgcttcgttattcgtttgatctagatgatgaagcgaaagtgattgaaaatgcaattgaaaaagtattacaacaaggatatcgaacaagtgatatcatgtcagataataaaactttagtaggaactaaagaaatgggtgacttaattgttgcaaatttataagggggatagaaaatgaaaagtgataatgtaaaaaaagggatgcagcaggcaccacatcgatcattatttaatgctttaggtttaactgaagaagagatggataaaccgttaattggaattgttagttcatataatgaaattgtccctggacatatgaatcttgataaaatcgttgaagcagtaaaaatgggagtagccctagcgggtggagtacctagagaattcccggctattgcggtatgtgatggaattgctatgggacatattggaatgaagtattcgttagtaactagagatttaattgctgatagtactgaagcaatggctttagctcatcaatttgatgctttagttatggtacccaactgcgataaaaatgtaccaggattattgatggcggctgcaaggatcaatataccaactatctttgtttctgggggaccaatgttagctggacgcgtacatggtaaaaaaactagtttatcatcaatgtttgaagcggtaggaagctatagtgcaggtaaaattgatgaggaagaagttcgttattatgaaaatcatgcttgtccaacatgtggttcatgttctgggatgtatacggctaattcaatgaactgtctgactgaagtgttaggaatggggcttcgtgggaatgggactattcctgctgtctattctgaaagaattaaattagctaaacatgcgggaatgcaaattatggaattgttaaagaaagacattcgtcctcgtgatattatcactaaagaatcaatgatgaatgctttaacgatggatatggcgttgggatgttcaactaattcaatgttacatttgccagctattgctcatgaaattggttttgatttcaatataaagtttgctaatgaaataagtgaaaaaacacctaatctttgccatttggcgccagctggacctacttatatggaagacttgaacgaagcaggcggtatttatgcagtaatgaaagaaatcagtaaattaaatttattgaatcttgattgtatgactgttactggtaaaacagtaggtgaaaatattaaagatgcagttaactttgatcctgaagtaattcgaacaattgaaaatccatatagtaaaacaggcggattagctgttttatcgggaaatttagcgcctgatggtagtgtagtaaaacgctcagcagttgtgccggaaatgatggaacatagtggtcctgcaagggtctttgattgtgaagaagatgcgattgaagcaattaaaggtggtaagatcgtagcgggagacgttgttgtgattcgttacgaaggacctaagggtgggcctggaatgcgcgaaatgttgaatccaacctctgcaattgccggaatgggcttaggatcaacagtagccttaattactgatggtcgattctcaggggcatctcgtggagcttcgattggacatgtttcacctgaagcggcagtaggtggaccgattgctttagttgaagaaggcgatattatagaaattaatattcctgaatataaaatcaatttaaaaatttctgatgaagaaatggcaaaacgtaaagctaaatggcagccaagagaaccaaaagtaacgactggttacctagcgagatatgcggcaatggtaacttcaggtgatcgtggtgctattttagaagtacaaaaaaataagtagagggaggtatttaaatgttattaacaggttcccaaattgttgctgaatgtttaattgaacaaggtgttgatacagtgtttggttatccaggtggaacaattctaaatatttatgatgctttataccaatatcaagataagattcatcatatcttaacatctcacgaacaaggtgcggcccatgctgctgacggctatgcgcgctcaacaggaaaggttggagtgtgtatggcgacttctgggccgggagctacgaatctggttacagggattgctacggcttacatggattcaacgccattagttgcaattactgctaatgttgcagtatcgctgcttgggcgtgacagcttccaagaaattgatatcgctggagttactatgccaattactaaacataattttattgttaaagatattaaagatttggcaccaacgatccgtaaagcctttcatattgcgagcgaaggtcgtcctgggccggtattagtggatataactaaggatgttacagcggctaaatttgattttgagtcaattgttccagaagtgatcgaaccacgtaaatatacttatggtgctcaagaattagatcaagctatcaagatgattgaagcaagtgaaaaaccatttatttttgttggtggtggggcaatcgctagtgatgcggctagcgaattgaaagaatttgctgaaaaaattgatgctcctgttacggattctttaatgggtaaaggcgcatatgataatacccgtcctcgttatactggaatgttagggatgcatggaacaaaagcctcaaattttggggttagtcaatgtgatttattgattgttgtaggggcccggttctctgatcgagttactggagatacaaatcgttttgctaaagatgcaaagattatccatattgatgttgatgctgctgaaattaataaaaatgttgttgttgatttagggatcgttggtgatgctaaaaatgtacttaaagaacttaatgaaaaattaacacgtcaaaatcatcctcaatggttaaaagaaattcgtgatttaaaagaacgttatcctttaagttatgatgatgaaggtttaacaggtccttatgtaattgaacaaattgattatctcactaatagtgaagcaataatttgtactgatgttggacaacatcaaatgtgggcggctcaatactttaattatcgtcgccctcgtcaatttatttcttcaggtggtgctggaaccatgggatttggtttaggagcagcaatgggagcaaaattagctaatccccaccaaactgtctttaatattgctggagacggatgttttagaatgaatttaaatgaattagcaactctaagccgttataatattccagtaattcaagtcgttatgaataatcaagttttaggaatggttcgtcaatggcaaacattgttctatggacaacgttattccaacacaattctcgaagataaagttgatttttgtaaagttgctgaaggtttaggttgtaaagcaattaaagttacaactaaagaagaagttgcttcagcaatcaaaattgcaatggagcatgacggtcctgtagtgattgaatgtatgattggtaaagatgataaagtattcccgatggttgctccaggtggtgcaattgcggaagcttttgacgatactgatttaaagaataaacaataggtagtaatttttaattactatctttttgttttttaaaagtatttattataatatgcattgaaaatctaaatatcaagtgtaataattgaaatataggataaggttataagggggcaagacaatgcaaaacgtatacaaatgtgtctatgattatgatgatcagcaaattgacaggttaacaaaaaacggtagtagtattcttggattattcaaggtgattgtggagaatgagcgttttgtattaatgccggttaatcatctaaatgctaaagataggagcgtttattttaatgagattgaaaaagtaaagatgactttatccacaggtgcagcaacacgaatcactattaatcgtgcgacaatttatcaaattgatttaaatatttattttcatgatggttcattatttactttagaatttagaagttttcgaggggttgtatcattgataaagaaatttgcagaattacatatctatgtatatgatccgatgaatttattggagattatttcaatggatgatcgttgggcgattgaaaaatattttgcaattaaccttgagaaaattaaaaaacaatttcaagttgaagaaatgcgaaaaaaagatcgctatgttaaagcgtaatgaggaaaagggggaatataaatgaatgtagtgttaacgggtgataatacaaatattacaccatacatagtaattatggtaattgctatcgttgttatcgcaggagtattgatttatcgcaaaaagaaacaaaaataaaaaaagaaaccgctagcgataagcggtttctaaagcttttttcaagactttaggatctttattatatggtgtgaccttacagattggtttattgattcctagtaatgtataaactgcaattcttgcggctcttacagaatattcttcggtaaagaccatatcctcagggatttctacaaattgagaaatcatcgcaaagttagtagatcctttgggaacaacatgaggtcgatcgctcatttttcgaggctggaactgggcatctacatatggcatcatacatggaatgacattgatgatgtcttttttaatttcctctttacgatcaattaaatgaagatgatatagtaattcatcaaaaatttcttctccagtacaatctttcattggttttttaatatagtcgcctaaacgatcagtgtataagccgtaagcccaaaaaattgtagtgttagcatcttgtgctttgaaatgcggttgggctgcaacgaccatcgacattagccatgatgagtctttaaaggtcattaaagcaccactaccagggatgttagttgagaattcctcaattattttaaggaatttatttcctttaaatgtcacagtaatactctcccagtttgtttctttaatgttaccaaagaatggctcaggattaccgaggtttggtttcttttgggcaaccttataccagagttcgccagaaattggtttttcaagaggtttaggagcaggagttttgtaatctcctaaggtagcactgtcagtcatacatgcattagtcataatacaaatgtcattatcattgagaatgattttttcatctttgccatctttatttaagtaaagcactttaacagtaatagtatcatcatctttaaaatcaatatctgtaacagtagcgtttgttacaaagttgacatgatgactatctaagtatttcttgattggtaaaataactgactcaaattgattatatggtgttcttgttacgccggctaatgtttcgatacgtgggaattcaaaaatcatgcggttcatatagcgttttaattcaaaaacacttgaccatttttgaaaggcaaaagttgtttgccacatataccagaagttagttgtaaagaaatgaggtgcatctttaaaccattgttcaatcgtaatatcatcaagtttagattcaggagtaatcattaattttcctaaagttaagcgatcgttattatcaaagcccattgacttaacgtcaagaatttttccatgacgatcaattaaacgtgcccgagcttcagttggatgtaaatgatcaaaatctagtatttctttagttacgctttgaccaggatggtcaagtgaaggaattcgatcgaataattcccaaaaattctcataagtttcttcatttaacattcgtccgccacgacaaacaaatccatctttaattgatccggcaccatcattactaccaccaagaattttcatgccttcaaaaatatgaatatttttaccatcaacatgaccgtcttgaatcaaataggcagccgcggccatactggcaagcccgccaccaattaaataaaattgttggtttgtaatttcaacaggttttctaactgtatctttgttatcagcgtatttctttgctgcaactgctccagctccagctagaagagctgctccagttaataattttgttttagttttcatttttaatatccttctttcttctaacaaatactagtatagccagaaaaaataaaaagtatttaaacaaagatttaactttgtctaaatactagacagatataattaattgtctaattatttaataaactagcagcaaaagtttcactttgagtagcgattttttttagtccgtgtgcaagttttgcaggctcatttttcatattggtttttatccagcggagtactgttccggcaattccataagcataaaattcactaaaaaaattcttttcttgtggggaaacggttttgtttacatcaagcttagtaatcgcatcataaaaacatttctgagccagattatatagatcatgataaaaatattgttcattggtattgatagtgctaatataaaaatctttttcttgatatattttttctaaaactgttaatagacattgatcccagttgtcaaaagtaatgatattctcgatatctgcaaataattcatcataatataaccactgtaataaatcatatttatcttggaagtgataataaaaagtttgacgatttagaccacatttattagttagatcgttaatggaaattttttcaaagtttcgatactgacaaagttcttttaaagttttagccaaagcccgtttagtgattaaagaatcagacatatagttcacctcgatgattattgtaacaaatttttatgaataaaacatttacattaataataatcttgttataataagtatataatctttcgttttattgtgatgaaaggcaaaaaaggggggggagatatttggttaaaattacagaattaaaaacgaataatattcatcaagtacgattatgtttttataatggtgaaatttggactaaaaacgatttagctaaacatactggtctatcacttgcagcaacaacgaacatcttacaattattactaaaagatgatgaaattaagcttgttggagaagcgcagtcaactggtggtcgcaaatcaaaacaatatattctaaataaagattattatcatttaggtaacgtaagtttaaaaagagatgatcaatattattattttcttgttaaaattacagatttattagggaatattttaaaggaagaaaagcttattagtgaagagggttcaatcgatgaattactagaagccataagtaatttaatttgtgatgattataaagtaacagtgctagcactaagtatcccgggagtgtgtaaagatggaaaagttggaatttgtgattttgaagcgttacgaaattgtgagttgttaaagctgctgaaagagcatttcaatcttgatataataatggacaatgatgttaatgcggctagcatagggtttggaattcattatccaaatgctaacaatttagcgttaatgtatcagcctaagattaaatatgttggatgtggtattttaattaatcatcgattatgcagcggatattctaactttgcgggtgaactatcatatttgccgtttatgagccatcatgagcaagatgaaatgttgtttaaagctccaaatgatttactattaaaacaattagcaacgatttgttgtgttatcaatccggaaattattggtgtttgcagtgatgtatttaaagagtttgattcgagtcaattaattaattatttacccgcagaacattggcctaaaattattgatatcgataatttagatcaattaattaaagatggattgtatagtttaggaattgaagtattaaaaaataaaatgcgaaagagagatagataaatggaaaagtatattgatttacacatgcattcaaaatatagtgatgatggtgaatttactccgactcaattagttgaacaatgccacaaagcaggaattaaggttatggcaattgctgatcataatagtgttaaagcgattgatgaagcgaaagaagcagcagctaaattaaatattaaatatattcctagtgtcgaaattgactgtacttataagggaatcaacctacatgttttaggttatggggttgattatcatcatgcggatttcgtgacgttagaagaaaatgtattgaaccaagaactagcatgttcaaaagaaaaggtaaaattaacaaatatgttaggttttgatgttgatcaagcagcgttagatgctttaagtgataatggtgtttatacgggggaaatgtttggtgaagtattattaaatgatcaacgttataatgaaaattctttattaaaaccatatcgtagcgggggagaacgtagcgataatccatatgttaatttttattgggatttctatgctcaagggaaaccatgttatacagaaatagtttatccgactttaaaagaaacgattgatttaatcaagaggcatggaggaacagttgttttagctcatcctgggaataatttaaaaggtaaatttgagatttttgatgagatggtggaattaggtgtagaaggggttgaagcttttagtaattatcatagtcctgaaacagttgaatatttctatcaagcaggaaaaaaacatcagattttgattacatgtggtagtgattatcatggtaaaactaagccggcaattgagcttggtgaatgtcgctgtacgatcgatgaacatgatattgaaaatcaattaaaagaatataaattaatctaattataagagcgtaatggagcgctcttttttatcaaaaataaattataattgttctttaattgatacaatcactgtgctataatcggggcgtataaaaggggatcagtaacatggatataaaaaagaagaaatgcttgattagctttggtgctgtgtttttatcatcgttaatcatggcttttgcaacaaaaaatttagttcggccagccgggattttatcaggcggatttatgggaatcgcaataatgatcgatatgattgctgaactaatcgggcacaatatacctacttcaattggcttattgtgtttaaatatcccagtagctttattttgtgcaaaaaaaatatcaccacgatttgttttcttttcgcttttgcaggttggtctgacatcgttgtttttaccattgatgccacaagttccattatttgatgacaagatattaaatgttatttttggtggatttatgtttggcggaagtattgtaattgctttgaaaggtaatgcttcaagtggtggaaccgattttatagcattgtatgtttccaataagagcggaaaggaaatctggaatcaagtgttcatttttaatacaataatgttgtgtgtatttggatatatttttggttttgaggcagcaggatattcaattttattccaatttatgtcaacaaaaacagtttctaattttcatacccgttataaacgtgtaatgatgcagattttcacaaaaaacaaagatgatgttatggcaatatattgcaaaaagtttcatcatgggattacagctttagatggaatgggtggatattctaagacgccggtttctatgttaacggcaattgtttcaagttatgaggttgatgatgttgttactgctttaaaagaagttgaccccaagataattattaatgtaagtaagtcagaaaaatatgttggtcgtttttacaatgcaccattataaaaataatcccgttagtttaactggcgggattatttggtattagtattttgacaataaagtaaccttcatcttcttcgaatttaattaaaccttggtaatggttgactaatagtcgtacgttattaataccaattccatgatgctcagagtcaactttagttgtatttaaatctggattagcagctagaacactatctttgatactgtttttaatactaataaaataatactctggttttgtcccgatagaaacccaaagttgtttattgaaatttgaatcgcaattttcaattgcgttgtcaattaagtttcccacaataataaagaaatgggcatcttccagtggaccaatggtattatgacaactagttataagatgaatctctttatcctttatttgattaactttttgtaataataaataatctaataattcatttccagaagattgaacaaagttattgctatttaaattatgattatattcattgatgattttaaaagcttcattataatttttattagttagttggtattttatggcattaaagacatggataatatcatgtttccaatttcttagttgttgataattattttcattgatactttgaatagtttctaagttttcaattttcatactttttcgttgtaattcgagaatacgatattgttcgcgctgggcctcaaagaatacaaaacaaagacagattgttagggcatcaataagcaataatagcaatgttagagtggaattaagattatccccataaaatatgtaatcaacagtaacgctgtaaataaagtttaataaaacaattgaaattgtaatatatttaagtacttgactttctaaaaaataatactttttaatatgactggctgttgcaagtacgagaacaagtaagattggttttgaaatcatagccattaaatgataaccgtcaactgaatcgattggaaatttggctagtaaagtagagaaacaaattgataaagtagttgctacattaacaagagtattaatgaacaaagcgataaagatattttgtaaataattcgctttatttagaaagtgtgaataggaaaagagaattagaattgaaagaacaatcattattatttcgggtgatgatgtaaaattacatgctgttatgactcccgaataaaagagagaggcaatcaaataggtggaaaatttcctgttaaataatttgtatacaaataatgtgcaaataaaagcttcagtaatatttataattaaatcaaaatagctcatagtaacccccaaatatagctttgatagtgtttttcgaaatgtttattatatcctaaggatatgattagttcgatattattttttaaacaaattttattctttttaatatcttttatatgtaacatatttattatagtagaacgattaatgcgtactaatccattagaaaggtgggatttttcaatgtttcctatagtgtcacgaatacaaatagattttttgttttcatataaaaagatataacataagtgatcttctacaatgatgtaataaatatctttgatgcgaatatttttcttccgatcgtaaatataaccagtaataaatttatcattctttttcaatgatttaaataactgattacagacattgattatttctattttaatattttgtttattaataaactgaaatggatgaatattgtatgcgtttgcgcgataatcattattattagtaacaactataatttttgtttcataataattattaagacgttcggcaaatgaaaaaccatcttctttaggcatttcgatatctaagaagatagcgtcataaaaaatactcaaatcaaaattcaatgaattattataaacatcaagtttatattcaatattatgaagctgacattccttttctaatgtcgataggattaatttttggtcaaaatgattatcatcaataattgcaaacttatacatagttatttctcctttagtgactattatatacgaaacttgacgattcgcgaaataaaatagtactttacgacatatatattgtattaatttggtgttatgatattgtgatgaaaggagatgtggttatgattgatagtttatcaaataagttagtgaattatttagacaaaggtaattatttagatgaggataaagaaatataccttcatggagctaagctgattatttctgaagtgattgggacgttgctgcttttatttttgggtttaatgactaatcattttattgaagcagttgtttatgaaattgttttatcaagcacaagatcaattttaggcgggtatcattgtaaaagttatgccgcttgtatttgtacatatgctggttttttcttggcgggtgttatatttttaaattattatcattttacattaatgacaatattaatagtgtgtttgattggttcaattaatattttagctttaggtccagtagataacgtgaataaagttgcgagtaaaaagaagaaagatgtattcaaacgttattcaaaaatagtcttaataatttatctaacaataatagcggcattattccatattcataatggatatttagacataatggtttatatatttattgtgattaatctactaatgttgggagggaagattgattatgaaaaatctaaaaagtaaagtattaaaagttttaagttcaggtttatttttagttgctgttcaagcggtaagtgtatattcacaaagacatatttatcaagaacaagaacctgaggcattaaagaaatacgacagatattaataagaaaaggattgagataaattgcgtatctcaatccttttttgtatgccgggcatggcatatatctaggtggtgaaagtccactgtgggggtgccaaccactagccaatatcaagggtgtctatcgtgaggtggaatctgaaagaagatggaggcaaaatcttggtccgaggaacatgaatcacatcaggcatataatggggacgagtgtgcaaagcaacatgaagtcataagaggttgtggaatgaaactattatatgtaaatgtggcagatatatggaaggaaagagatatgaccttatcctgggaggtctcatgatggagaaatcctagtaataatgaatcatgggaagtcagcagaggtcgtagtagcaaagaagtggctgtaatggtcatgaagcgaaggcccgaaagaagaatacaggggaagtgagtataatggatagcgaaagaaatggaggtaacggaaatatgaaaactgataatgcattgcttgaacagatgcttagtgatactaatctaggactagcatttacacaagtaaaacgaaacaaaagtgcaagtggagcagatgggagtagatgaacttaaaggttatctagaagaaattaaggacagtatacgtaacaagacatataagccagaacttgtacgaagagtagaaatacctaaacctgatggcggagtacaaaatttaggagtaccaacagtacttgatagatttgttcaacaagccatagcccaagtattaatacctatctacgaatcaatatttagtgacaatagttttggctttagaccaaataggtgttgcgaaatggcaattatcaaagcgttagaatatatgaattaaggctttcagtaggtagtagatatagacttggaaaagttctttgatacagttaatcacgataaactcatctcacttgtcatgaagggtgtaaaaagtgaggagatagtatctctaattagaaaattcctagtgagtggaattatgattgataatgaatatagagagtcagtcgtaggaacaccacaagggggaaatctaagtcccctactcagtaacatagttctcaatgaactagataaagaaatggaagcacgagggctaagattcacacgttatgcagacgattgtattatattagtgggtagcagtaaagccgccgatagagtaatggaaaacattagtaaattcatagaaaagaaacgtagatttaaggtaaacatgactaaaagcaaaattttgaaacctaatgatattaaatatctaggatttggtttctactatgactctttttcatctatgtggaaagcaaaaccacatgagaaaactgcaaacaaaattgaagaaactaacaaatagaagttggtcagtatcttgggaatatagaatacttaagataagacaactgatagttggatggattaattactatcggataggaaattttatgggtgtatgtagaaaactagataaacaaataaaatttcgaataagaatgtgcctttggaagaagtggaagacgaacaaaagcagggaaaagcaactaataaaattaggagtattaccatggcaagcaaagacttaggcaaactgtcgtgagtcatatgcaagatgtgcaagcacatttctacaaacaaaaatcacaaacaatttactatataaaaaagggctaccatcaatggtagtccagtatcagttaaaacatatttcaatatagatttaaaccgtcgtacggcacgtacggtggtgtgagaggtcgaaaataaatataaaattatttattttctcctactcgattattttattaaattgttttctaataaaaagttataagcaacatcttttgttttttgtttttcttcatctactttataatttaggtctatcattacttcttcgtttagataattttgtaattgattaactaattcaatgatttctggacattcatctttgattctttgattaatgatcggaatagcattgtatggtaagaagaagtttttgtcatcagttaacacctttaagtcaaatttctttaatagtccatcagtagaaaaagcatcaactagatcacattcattattaactaatgctgtatatcgaggtgaaccgtcaattgggataacttctttaaactgaagtggatatgtttcttgtaaaccgactaagcagtcttttctttcaacaaatgttaatgttggtgaaaagattaattgattagaaactttacatagatcactaattgtttcgatgttatatttatcagcagtttgcttgctcattgctaaggtataagtgttgttaaatcctagtggttctaaaacggtaaaattatattgttttttcatttcgtctttgactgtgttgtagacagcttctacgtcactgttaggctcaaggccgagaacactaccgtaaatagttcctgtataatcgacatacatatcgacatcaccagttttcatcgcatctaagacgattgacgaagagccaagtgataatgactggtttacttctacatcggtatttttttcaatcaaatactttaacatatagttcaatatttcttgttcagaaaagtccatactaccaatattgattgtgattttatcgctagttttgcctaaattagtataaacaaaacttccagctagacagatacaagtagcgataataacgatcttatcaataagtttttttcctttgctttgtggactggctagttgattgcatttaggggtaactaagacttctaaaattgaaaaaatataatcaatcaataatgctaagatacaggcaggaatagctccggctagaatctgtgcattatttactgttcggattcccgcatagactaaataccctaatcctccggcaccaataaaagctgctagagtcattaacccgactgaactgactgctgagattctaactccggccatgataacaggtgctgctaaaggaatttgaactttataaagaacttgcattggtgttaatccgattcctttagctgcttcaagggtatcgctattaatgctatccaatccagctacggtattttttataattggtaataacgaatacaagataaccattacaatcgctggttttgttcctattcctaataaaggaatcatgaatcctaacaaggccattgatggaattgcttgaataatatttgcaattgccatgactggtttttttgatggtttaaaataagtaataatgattcctagtggaactccaattaaaattgaaataataatagcaagaatcgttagttgaatatgatcgataaagagtccgaagatagttgaaaagttttgactaaagtaattaataaattcattcattttaatcatcctcactttcatcatatttctttgataaagtggttactaatgtactcttagtaattaatccaactaatttgtttttatcatcaactactggcaaagtgtaaatattactgctgttagctagattgatgacatcaacgatagattcatcgggtttaactgataaacattcggtatgcattacctcatcgacctttttatcacgattcttttctctagctgcttgattagcatcaagaattcctaaaaagttttgatgattatcaacgatcatcaaactatcaactttataattatacataatgtttacagctttgatacattttaaattgacattacaagtaattggcttatcaatcatgatatcagctaccttgattaattctggcgaatcccatattcgtttttttccaacgaagttatgaacaaaatcattagcaggatgctttaaaatttgttcaggcgtatcaaattgttggacacggccatcagacataatacaaattcgatcagccattttgattgcttcagccatatcatgagttacaaaaataatggttttatgtagcttgttttgtaacgttagcaactcatcttggagttgttctctggtgattggatcaagagcactaaatggctcatccattaagatgatctctggatcactggcgaacgctcgggcaactccgaccctttgctgttgaccgccactcatttgagtagggtataagttcatatacccttctggatcgagtcctaccatatccaatagttcaacaaccttggtggcaaggctgggatccttcttgttttttaattttggtattaattcgatgttttctttgacagtcatatggggaaataatcctgtctgttgaattacataaccaatatttcgtcttaaatcaatttcgtcttctttgctgatgtctttaccgtcaacatagatagccccacgagtaggcttgatcaagcggttgatcatttttaaagcggtagttttaccacagccactaggaccgatgatacaaacgaattctcccttatcaattgaaaacgaaacgtcttctagtacatgtttgtccttaaaagacttatagatatttttaaattcaatcatttaatcattcccttcttaagtacctattatatcacagaaaatgtgtactttatgtgaatatggtaatttacttctattgttgtgataataaattagcatgatttcatcaataaaattgtttattgatggggtgttcaacagcataaaaaccgccgttgaagctgtatgcgtgataaccacagcgcgttaatttttgagctagatcaagggatcttttgccgctgtaacagattaaataaataggcttatctttggggaattgtggtggagtggcgataaaagtatcgtaagggatattgatgaacttgcgcaaatgaattttattaaattgtaaaggatctcttaaatcgataaatgtataatcatgttttagtaattcgggtaatttgtcgacactgattaattggctgttttccatatatttcacctcattatattgtatgaaattaattgaaaacaatgaataacagtgatataattcagccatggaggaatattaaagatggataaaaaaacaatcaaagatatcgaagtcgctggaaaagtagttttatgccgtgttgacttcaacgtaccaagaaacaaagaaactggagaaattacaaatgataatcgtgtggtagctgctttacctacaatcaattatctattagaacaagctccaaaatgtgtagttttattctcacacttaggaaaagtaaaaacagaagaagacaaagctaaaaatgatttagctgttgtagctccttgtttagaaaaacatttaggaaaacctgttacttttgttaatgcaacaagaggaccggtattagaagatgcaatcaaaaatgctgctgatggagcagtaatcttagtacaaaatactcgttatgaagctggtgaatctaaaaatgatcctgaattaggtaaatattgggcttctttaggtgatgtatttgttgaagatgcatttggttctgtacatagagcacatgcttcaactgctggtatccctgctcacttaccaagtgcagctggattcttagttgaaaaagaaatcgcttatattggaaaagctgtaaatgatcctgaaagaccaatggtcgcaattttaggtggagctaaagtttctgataaaatcttagttatcgaaaacttattaaaagttgctgataaagttatcgttggtggaggtatgtgctatactttcgctaaagctatgggtcataacattggtaactctttagttgaagatgacagaattgaaatcgctaaagaattaattgctaaagccggagataaattaatcttaccaatcgattcaatttgttctgataaatttgctgtagatggtgatatcaaagaatgtggtgaagatgtacctgatggatacatgggattagacatcggacctaaatctgttgaattattcaaagaagcattacaaggtgctaaaactgtagtatggaatggtccaatgggtgtgttcgaaatggaaccatttgctaaaggaacaattgctgtatgcgaagctttagctaacttagatggtgctaatactattatcggtggtggagacagtgctgctgctgttatgcaattaggatatgctgataaagtttctcacatttcaactggtggtggagcttcattagaatatatggaaggtaaagttcttcctggtattgctgcaatcgatgataaataataaggggaaattataatgagaaaaccaattatcgtaggaaactggaaaatgaataaaacaatcgctgaaacaaaagcgtttgttgaagctgtagatgctaaagtatcagacagtgctgattggggtattgctactccatacttagctttacaagctgcaaaagaaggaactaaaaaattattagttgctgctgaaaactgtcatttcaaagatagcggagcttatactggtgaagttagtgttgaaatgttaaaagaaattggagttgaatgggtaatcctagggcattctgaaagaagacaatattttggtgaaactgatgaaacagttaatgctaaaatgttacaagtattaaaaaatgatatgactccaatcgtttgtgttggtgaaacattagaagaatacgaagctggaactactaaagatgttgttaaaactcaaacagttgctgccttcaaagatgtttgccctaaatgcgcaggacgtactgtgattgcttatgaaccagtatgggcaattggaactggaaaaactgctactaatgaaattgcacaagatgtttgtggatatattcgtagtgttgttgctgaactttacggtcaagaagttgctgatcaagttagaattcaatatggtggatcagttaaaccagaaggattaaaaactttattagaacaaccagatatcgatggtgctttagtaggtggagcttctttacaagctgattcttacattgcaatgattgaaaacttaggataataattgagagacttcataaagaagtctcttttaatatgtatatttttatttaaatagggtataataaagaaggagttttattaattaaattaataaagcatattagtaactattattgttaaactatgctatagtgtagttgcaagggatagataaattaaaaaggaggtttgaagatgaaattattaaaatgtccaatttgtggaaatgttgtggaaatggttgaggatcatggagtaccattaatgtgctgtggtaagaaaatggaagaggttgaagcaggtgcggttgatgcggcacttgaaaaacatgttccagttttaaaagtagaaggtgattgcttaactgctgttgtaggggatgttttacatccaatgacaccagaacatttaattagtaatatttggattgaatttgctgatggtagcaataagaaggtcacactaacttctgatgacgaaccaattgctaagtttaatattgctggtaaaagtggtaaagctacagtctatgaatattgcaatcttcatggattatggaaaacagaaatcgaactatagaaacctccattgtggggtttttatttttgtccgtatataataaaaagaaagagtgttctgctgatattatctttactgttagtctgggggttccagttttaggagtagtatcaagtgaatcactctttttagtttaaaattacgactaaggtcgaagaccactaccaccttgaatcgtcatagtttctccggtaatgtagtgaccggcttcgctagcaaaaaagactgctgcacttccaatgtcattttcaggatcagcaaagcgttgcattggaataccttgaatagttttttcatataagtcagggtactcttccttccatttagtaagaccttcagtcattgctaaggggcaaattacatttacattaatgttatcaggaccccattcagctgctgcaacacggcttaaccctcgaatcccttctttggcagcggcataagaagattgcccgagtttgccaaatagtccagcccctgaggcaaagttgataacactaccatgactttcttttaaatatgggtaagcagctcgcatataaaagaaggttgcgtatagaccggaattaattgctaaatcaaagtcttctttagtatggtcttttaacataacgccagatttagatgcctgtgcgttatttacaacgatattaatttttccataatatttgatggttttgttaatgacattattaacatcatcttcattagctccatcagcaggaatgcatagtacattgatttggtattgagattctaatttctctttagcattgtgtaaagtatttctgtttctcccggtaataactaggttagccccggctttagcaaaggcttttgctaacccaaaaccaataccacgaccaccaccagtaataatagcgactttattttgtaatgttttcatatcatctctcctttagttagttatagctaacttatttgatatattagacgtatttattaatgttgtccaataatatgcaataataatattcccgaaaacatttattttattagatgaataagataaatgttttagtataaatcttatagtaaaggaaataaagcaggttttattattagatgatctaagatatttgaccataaataaaaataatttagagaaaaaaataaaaaagtattgcatttatcgaataataatgtataatccttagttgacgcaatatgtgttactatgcgtggaaggacaatgtccatttgaccacagcacggacaaattttatataggaggtatgtcacgtgagtaaaaaagtcgcaagagtcatgaagattcaattcccagctggaggagctaaaccaggtccagcattagcaggagcaggaattcaaatgcctaaattctgtacagctttcaatgatcaaacaagagatcgtatgggtgaaactgtaccagtagttttgactatttatgaagataaagattttagttttgtactaaaaactgcaccagcagcggaaatgattaaaaaggcttgtggaatcaaaaaaggttcaagcaatgccggaactactgaagttgctacattatcagctgaaaaattaaaagaaatcgctgaatacaaaatgccagacttaaacgctatcgatttagaatcagcaatgaaaatcatcgctggtactgctcgtaacatgggtgttaaagtagaagcataattaaagattaaatattaatcgtcatttgtggaaggataatccgtttgaccactaaggaggaaaaataatggcaaagaaaagtaaaagatatcaagaagctgctaaattaattgaaaaaggtaaagcttattcaatcgaagaagcagttgcattagtaaaagaaactagtaaagttaaatttgatgccgcagttgatgttgcatttagattaggagtagatcctcgtcaagctgatcaacaattacgtggggcattagtattaccaaacggtactggtaagtctaaaaaagttttagttgttactgaaggacctaaagctcaagaagctaaagatgctggagctgatgttgttggtggtaaagaaattttagaagacatcaaaaaaggatggttagattttgaagtaatgatcgctactcctgatatgatggctgaattaggtaagttaggtcgtattcttggacctaaaggattaatgcctaaccctaaaacaggaacagtaactatggatgttgctaaagctgttaaagaaacaaaagctggtaaggtaacttaccgtacagataaagaaggaaatgttcaaatgacaattggacgtgtttcatttgataatgataaattagtagaaaactttacagcaatctatgatttattagtaaaaatcaaaccttctacttcaaaaggtgtttatatgaaaaacattgttgtctcatcaactatgggacctagcattaaaatcgcagccgctaaatagtagctgctaaacaaggcgcaatcaatatacccaagacagtaactgggaaaccttaatttgttaccgaggtgttaaagagatatatattatatattgactttgactctcgtttaaacgagagttttagtttgagtatattgttgcatatataaaaatttacaggaggtgtgacaatgtcagcagaagcaattaaagcaaaaagcgcattagtcgaagaaatcgctgctaaattgaaaggagctcaatctgcagttgtagttgaatatcgtggtttatctgtcgcagaaatgacagaattacgtaacaacttacgtgcagaagatgttgaattaaaagtttataaaaactcattagttcaaagagctactgtagcaacagaatatgaaggacttaatgcagaattaacaggaccaaacgcaattgcacttggtaatagcgatgctgtagcaccagcaagagtaatcgcaaaattcgcgaaagatcatgaagctttagtaattaaagcggcagtggttgaaggtaaattattaacagtggatgaagttaaagaaatttctaaattacctaaccgcgaaggtatgtactctatgttacttggaatgttacaagcaccagttagcaagtttgcacgcgtagtaaaagctgttgcagaagctaaaccagaagatggtagcgcagcagcagaagaagcagcaccagttgaggaagctgcaccagaagcaccagttgttgaagaaacagctgaagaaacaaaagaagaaacagctgaataatcagctatataaattggaggaaaataaacatggcaaaattaacacatgaagatatcttagcttacttagaagaagctacaatcttagaattaaatgatttagtaaaagcaattgaagaaaaatttgacgtaactgctgctgcacctgtagctgtagctgctgctggagctgaagaagctgctggagaacctgctaacgtaactgttacattgacagaagctggtggaactaaagttgctgtaatcaaagctgtaagagaaatcactggattaggattagttgatgctaaaggtttagttgacaaagcaccatctgtaatcaaagaaaacattcctgctgcagaaggagcagaaattaaagaaaaattagaagctgctggagcttctgtagaagttaaataatttatatttgactaaataaagagcccttcggggctcttttatcttggaggacatatgaaacattactatacaaataatgaagatttaattagtgaaccagaacaatttatttttacttatcgtggtaaagaactaatatttactagtgatcatggagttttttctaaaaaaatgattgattttggatcacgagttttattagatgcaattgaattagatgagggtaaatctactttattggatgtggggtgcggttacggcacttttggggttgctcttaaaagtgcttacccggctttggaaatcgatatgattgatgtgaatgaacgggccttgttattagcaaaacagaatctagctgctaataatttagaagctaatgtttatttaagtagtgtttatgaaaatgttactaataaatatgatgtaattgttacaaatcctccgattcgggctggaaaagaaactgttacaaaaattttagttgaagctaaagaacatttaaatcttcatggagaaatttgggttgtgattcaaaagaaacaaggggcgccatcagctaagaagaatctagaaagtgtttttggtaatgcaaatgtcgtaaaaaaggataaaggatattatattttaaaagctattaacaagtaaatttacttgtcaatagtttttttgatatttttttatttttttgttgactttaaaatatccttgtgatagagtattaaaatgcctattaatgtttaaaatcaagcgcttttgcgcgctctaaaacatgttgatagagaaatataaaggggtggagttaatacgtggaaaacaaaataactgaagcaaaaagcaagattactcgtcgtaattattcaagaattagtggatctttagaacttccaaatttagtagaaattcaaacaaattcatataaatggtttaaagaagtaggtattaaggaagtatttgaagatatctacccaattactaactttaacgaaacattgtcgttagaattcgtagattgtacatttgatgaagcaaaatattcagtcgaagagagcaaagaccgtgatgctaactatgctgcaccaattagagcatctttacgtttagttaattctggtactggtgaaattaaagaacaagaagtatttatgggagatttcccattgatgactgactcaggaactttcatcattaacggtgctgaacgtgttatcgtatcacaattagttcggtctccaggggcatattttgctgatgccttagataaaagtggtaaaacagtatttaatgggagtattatcccttcaagaggtacttggctagaatttgaaacagatgctaaggatgttttaaacgtgcgtatcgatcgtaatagaaagatgccgggaactgtattattaagagctttaggtctttcaagtaacgataaaatcatcgatgtttttggtgaacacgagtatatcatcaacactttagctaaagataatacaactaatactgaagaagctttaattgaaatttataataaattaagaccaggtgaaccagcaacattagaaggtgctaacaacttattatatacgcgtttctttgattgtaaacgttatgatctagctaaagctggacgctttaagttcagaaaaaaattgagccttttagatcgtattgcgggacgtattttagcagaagatttagttgatgttgacggaaatgtagtatacccagagggtactgtagttactcaagaagttagtgatacaattaaaccaattcttgaagctggagctcatacacgtgaacttgataccaaccctagattagaatcaaacggtgtgatccaagtattagatgtttatgtagatgatactaaaactaaaaagatgcgagttattggtactgatttatctttagatagtaagtttgttactatttctgatatgatggctgcttattcatatatgtttaacttagtagatatctatgatgcgttagatttaacagctgaagatcgtgttaacttaatggctcggattggattattagatgatattgaccatttaggtaatcgtcgtgttcgttctgttggtgaattaattcaaaatcaatttagaattggtttatcaagaatggaacgggttgtaaaagaaagaatgtcattgtctgaagttgattcaattacaccacaatcacttactaatattcgtccgttaactgcggcaattaaggaatttttctcttcttcacaattgtctcaatttatggatcaaatcaatccccttgccgaacttactaataaacgtcgtttatcagcattagggcctggtggtctaagccgtgatcgtgctggttatgaagtccgtgacgtacatgcgtctcactacggaagaatttgtccaattgaaacacctgaaggtccaaacatcgggttgatttcaacattagcttcttatgctaaaattaatcaatatgggtttattgaaacgccatatcgtaaagtaaataattgtgttattgatgaacatgatgttcgttatttaactgctgatgaagaaaaaaattatattattgcgcaagcaaatgttagaactgataaagatggtacgattctagatgcccaagttattgctcgtcacttaggagaaaatatcatggctaagcgcgaagaagtagactatatcgatatttcaccaaaacaaattgtatcggttgctacttcttgtattccgttccttgaaaatgatgatgctactcgtgctttaatgggtgccaacatgcaacgtcaagctgtaccattgttaaatccacatacgccatttgttggaactgggatggagcatcaggcagctcgtgattcaggtgcggcagtagtatcacgtgaagatggaattgtaacatatgttgatgctaaaaaagtaattgttgaagataatgaaggggttgaacatcgctaccgtttatctaagtttaagatttcaaacaacggtacatgtattaaccacaaaccaatcgttaagactggggaaaaagtattgaaaggtcaagttttagctgatggtccggctatggaacaaggtgaacttgctttaggacaaaacgtattagtaggattcatggaatggaatggatataactatgaagatgcggttattatgtctgaaagattagtgaaagatgatgtttatacatctgttcatattgatgagtatgcaatcgaatgtcgtgatactaaattagggcctgaagaaattactcgtgacattcctaacgttggggatgaagctcgtaaaaacctaaatagtgatgggattattatgattggtgctgaggttaaagagggtgacattctagttggtaaagtaacaccaaaaggtcaagctgagctttcggcagaagaaaaattattacttgcaatctttggagaaaaatctcgtgaagttaaagataattcattaagagttcctcatggtggggctggaatcgttcatgacattaaagtatttgaaagaaaaaatggtgatgaattacaaccaggcgttaataaagttgttaaagtttatattgttcaaaagagaaaaatttctgaaggggataaaatggcaggacgtcatggtaataaaggggtaatctctaaaattttaccaattgaagatatgccacacttagaagatggaacaccattggatattatgttaaacccattaggggtaccttctcgtatgaatatcgggcaagtacttgaattacatttaggttatgctgctcgtcaattaggtttatatattgcaacaccagccttcgatggtttacatccaagtgatctagaagatatcatggctgaagcaggaatgtctaaagatggtaaacaacctgttatttctggtcgtactggtgaatattttgataataatatctcagttggaatcatgtatatgattaaattagcccacatggttgatgataaattacatgctcgttcagttggtccatactcactagttacgcaacaaccattaggtggtaaagcacaaaatggtggacaaagatttggggaaatggaagtttgggcacttgaagcatatggtgctgcatatacattacgtgaaatattaacagtaaaatctgacgatgttgttggtcgtgttaagacttatgaagcaattgttaaaggacaaccattaccagaaccaggattacctgaatcatttagagtgttaaagaaagaattgcaagctcttgcattagatattcgtctattagatgaaaatgataatgaagtagatatgcgtaatatcgaagaagaggaacatcgtttccctcgtagtatcgataaagatgaagtgattgaaactcctgaaacagaagatgaattagaagaagaaattcttgaggatgatttagatgttgaagaagaggaagatttcgaagatatcgacgaagattttgatgaagaattagaagaaatcgaagaaagtgaatcattataggaggaataaagatggcaaatacaaataaattctcagcaattcaaattggcttagcttcccctgaaaagattcgcgaatggtcttatggtgaggttaaaaaacctgaaactattaactatcgttctcaaaaaccggaaaaggacggattattttgtgaaaagatttttggtccttcaaaggactgggaatgtagttgcggtaaatacaaaaaagtacgttataaaggtgtagtatgtgatcgttgtggagttgaagtaactaaatcagctgttcgtcgcgaaagaatgggacacattgaattagcaacaccaatcgctcatatttggtatttgaaaggaattccatcaagaatgggacttatcttagatatgtcaccaaaacaattagaagaaattatttactttgtttcttatgttgttattgataaaggaagtacaccattagaatacaagcaagtattatctgaaagagactatcgtaaatgttttgaacaatttggtcatacttttgaagcccaaattggggctgaagcaattcaaacattattacaacaagttgatctagatgctgaatttgcaaaagtaactaaagaacttaaagaagctcaaggtcaaaagagaacaaaattattaaaacgattagaagcaattgaggcttttagaacttcaacaaatgaaccagagtggatgattcttgaagctttaccggtaataccacctgatttgcgtccaatgttacaattggatggggggcgttttgctacttctgatttaaacgatttatatcgtcgtgttattactcgtaataatcgtttaaagaaattattagaacttggaacaccttctattatcgtgcaaaacgaaaagagaatgttgcaagaagctgttgatgctttgattgataatggtcgtcgttcaaaaccgattactggtgctggtggacgtgcattaaagtcattaagccatactctaaaaggtaaacaaggtcgtttccgtcaaaacttacttggtaaacgtgttgattactcaggacgttctgtaatcgcagttggtcccgatttaaaaatgtatcaatgcgggattccacgtgaaatggcattgaatctattcaaaccattcgttattaatggtctcgttagggatcaattagcaacaaatattaaagctgctgaaagattaattgataaaatggatgatcggatctggccaattgttgaagaagttattcaacaacatccagtgttacttaaccgtgcacctacattgcatagattaggaatccaggcattcgaaccaaaactagttgaagggcgagcaattcgtctacatccactggttactccagcgttcaatgccgatttcgatggtgaccaaatggcggtccatgtaccattaggtgaagaagcaattcaagaagctcgtcaattaatgctaggttcaaataatatcttaggtccaaaagatggaaaaccaatcgttacaccatctcaggacatggtattaggaaattattatttaacacttgaagatgaaggtggcttaggagaaggaactgtctttgctgatcgtaatgaagttgatcatgcttattttgctaaaacagtagaattacacactcgtgtagcaatcaaagcgtcagcattaaagaatgaaactttcactaaagcacaaaatgattgttatttaatcacatctgttgggaaaattttatttaatgacatctttgatggtaaattcccatttattaatgatccaagcagtgaaaacttaatcgctactccagataaatattttgttccaatgggaacagatattaaagaacacattagaaatcaaaagattattaaacctttaaataaaaaatctttaggaaagatcattgatgaagtgtttaaacattcagcaatgtctgatacaagtttaatgcttgataaattaaaagaccaaggtttctattactcaacaattgctggtacaactgtatctgtatacgatatccaagtgccagaagctaaatatgaaatttttgaaaaagctgatgaaaaactagagcaaattaaaaagttctataataaaggtaaattaactgaatcagaaagatatcaaaatgtaattaaattatggactgacgttaaagacgaagttcaagaagttgtacgtttagagttcgaagctgatgatcgtaacccgatcttcatcatgtctgattctggagcccgtggatcattatctaactttacgcaattagtaggtatgcgtggattaatgtcaaatccaaaaggggaaacaattgagttgccaatcaagtcttcatttagggaaggtttaacagcatcagaattctttatctctacccatggtgctcgtaaaggttctaccgatacagctttaaaaactgccgattctggatatttaacaagacgtttagttgatgttgctcaagaagtaattatttctgaagaagactgtggaactgaccgtggctttgtagttacagaattatacaataatgatgataaatcagtcattgtaccattacatgaccgtttggttggtcgttattcacaaaaagatattttccatccagaaactaaagaattaattattgctggtggagaattaattactgaagcattagctgatgaaattgttaatgctggaatcactgctgtagagattcgttctgttttagggtgtaatgctaaaggtggagtatgtcgtaaatgttacggacgtaacttagctacaggtgatgtggttgaattaggagaagctgtaggtattatggcggctcaatcaattggggaacctggtacccaattaacaatgcgtacattccatgatggtggggttgccggtggtgccgatattactcaagggttacctcgtatccaagagttattcgaagctcgtaatccaaaagcaaaatctattattagtgaaatcgaaggagaggttactaatattattgataacgctggaagaatggaagtcgttattactaatgatttagaaacgcgtagttatttagcgccatacggtgctaaaatccgggtgaacgttggtgatcatgtcaatattggagctaaaatcactaaaggttcaattgatccaaaggaattattatcagttgctgatgttgaagcagttgaaaactatattattaaagaggttcaaaaggtatatcgaattcaaggtattgaaatttctgataaacatatcgaaatcatcgttaaacaaatgctaagaaaaatgaaagtagttgaaggtggggaaacaggttgtctacctggtacaaatattaatgtaaacgcctttactgaattaaataaacaagttttaaaagatggtaagcatccagcagtagctcgtccagtattactagggattacaaaagcatctcttgaaactgaatcattcttatctgcagcatcattccaagaaactactaagatcttgaccgatgcttcaatcaaaggtaagaaagatcatttattaggattgaaagaaaacgtattaattggtaagctattgccagcagggactggtcttcgtggagctcttaaatcaccggaaagattagcgcgcgaagctgaagaagcaatgttagcgagtcaagaagatatggatgatttaattgataatgacgatgaaatagaaatgatggaacaagcaggttaatccctgcttgttttttatgttaataaatttacttgcaatgctagttactaagtgttaatataaacttgtcactatatagtgacaaagagcggttgtgaatgaatctcaaatcttgaattagggatgtattttgactctttatggtaaatcacaattgtgtagtaaaataggaattttattttttcatggtagtcctggcagtggggcacatgcacttatgcagttatcgccttttcaagaacttgagaaatggtagcaatgtttttattttgatcaacgtggtagtggcaagtcagaatatgatctccgtaacggcttaacaattgaacaaattaccaccgatgtatttgctgttgtagaggtaataaaaaacaatgggatatagaaaaactgtggttctttgggtggatcgttttgaggttatttggcctgcttatgtatagtatgtttttatcaatcgtttacgggtcttgtttttaagcagctcggcgattatttttaatcatcaacagccagtagaattctttttttaatgaaatctttttatgcaaataaagtttgttctaccgataaagttcctacagcagcaagattagcaccagaagagtttttttcattatcatcaactcaagaatttgtctttagctcgcttaatacctctaattcattgcaacatattactgcgatgagcgactggttttattgttattattttggtttcctatttgataatttaatagttttgacgttaatcatgcaggaaaaagaaaatccgatttgtgcttatcaaaatcttgatcagcaaatcgaactaataaaaaatgaattaattcgatatcttttatttgctgattgtggggatgctgtttttgaggatcaagtagatgtttttgcagaagaaataaacaaatttatagaggagaaaataaaatgttagtatatatttgttgtgctggtggggcaacatcaagcttattttgtaaaaagattggggatgcctctaaggttccaactacagtggaagatatttttacagtattaaagaattatgatgagtatgataataaatatgagataattttagcttatggaccggctgagtttttaaaagaacgttgtattagggaatataatttaggtgaaaaaatttcaagtatatggattgctccgcaagaacgttttatgttgccgacaattcaaaaaatatttgcaaagtataataccccggtagcagctatcgatatgagaacatttggaacgatgaatggtgctaaagcattagcggatattcttgcattgtaaagtctatacaaccacacataaaagttctataataataaaaatggaggttggtaaatgtgattgatttgaatcaagtgatgacgtttactgaagcggcagataaatggggatttgctaatggcaatacgattcgtaaggcggttgaaagaaataaattcttgccagcggaaattcgtaaaagtggagatgtctggttaactacctatgcagcaatgctgcgggttttcggtcaaccaagaaaattggacgaagtgattacctaccaagagattgctgaattgataacggatgcagtctatttacataaaaatgtagatttagagatgaattcgattttccgacgaattgctggagcaattgaaaaaaggcaaacgataacggtagttgagtctcgaaataaatcagaacgaattttaatggttgttaagacaagagatgatttagaagcatttatgaatactttaaagcgttatttagattcagtagatataaaattaaagaaagagtaaaaactgtttaaatataaaaagcgtttaaatggtttttattttgtttattaatgatataatcaatttttttaaaaaaaaacaaataaaattattgacatatttatatttttgtaataatatgaactacggtgcccgcataggggcgcgttgtttattacgaaatatgaaacacccggaatcgtgtgcttaagtatggaagaaaggagaacaaggaatgcctacaattaatcaattagttagacaaggtcgtaacgacaaaactacaaaatcaaaatcaccagcgttaaacagaggttttaactcattagctaagaaaccaacaacaactaattcacctcaaaaacgtggtgtttgtacacgtgttgctactatgacacctaaaaaacctaactcggctttacgtaaatatgcccgtgttagattatcaaatggaatggaagtaactgcatatatcccaggaattggacacaacttacaagaacatagtgttgttttaattcgtggtggtcgtgttaaagatttaccaggggttcgttatcacatcgtacgtggtacaatggactgtgctggtgttaatgatcgtaaacaaggccgttcaagatacggtgctaaaaaaccaaaagcttaagaaaaatcaagtataggaggaaaattaaatggcaagaaaaggtcaagttgctaaaagagacgttctacctgatccagtgtacaattctaaaactgtatctaaattaatcaacaacattatgcttgatggtaaaaaaggtgttgctcaaaacatcttatatgatgcatttaaaaaagtagaagagaaaactggaaacccagcaatggaagtttttgatcaagcaatcaacaacattatgccagttcttgaacttaaagttagacgtattggtggggctaactaccaagtaccagtagaagtatctggtgaaagaagaatgactttagggttaagatggttagtgaactattctcgtttaagaaacgaaaatacaatggttgatcgtttagctaacgaaattattgatgcttctaacggagctggtgcttctgttaagaagaaagaagatactcataaaatggcagaagctaataaagcatttgctcatttccgttggtaatatccaacaaatgataacgaaaggagaaaaattatgtctcgtgaattctcattagagaaaactcgtaatatcggaatcatggctcatatcgatgctggtaaaacaacaactactgaacgtgtcctttattacacaggtaagattcataaaattggagaaacacatgaaggtgcttctcaaatggactggatggaacaagaacaagaacgtggtattacaatcacttctgcagcaacaactgcacaatggaatggataccgtgttaatatcatcgatacaccgggccatgtagacttcactgtagaagttgaacgttcattacgtgtattagatggtgcggttactgtattagactcaaaagcaggtgttgaacctcaaactgaaacagtttggcgtcaagcaactacttatggagtaccacgtattgtattctgtaataaaatggatgctactggtgctgacttcattatgtctttagaatctttagaaaaaagattaggggtacatggtgttgcacttcaattaccaatcggtgctgaagatactttcgaaggaatcatcgacttaattaagatgaaagctgtttacttcgaagggactaaaggtgaaaacgtaatttacaaagatatccctgaggaatatttagatcaagcaaacgaatatcatgctaaaatgttagatgctgctgcatcttatgatgatgatctaatgatgaaagttttagaagaagaagaaccaactgaagaagaagttaaagctgctatccgtaaaggtgtattggctgtagaattattcccagtattatgtggttctgcttataaagacaaaggggttcaaccaatgttagatgcagttattgatttcttacctgctcctactgatattccttcaattaaggggattgatgaagatggtaatgaaattgaaaaacatgcttcagacgaagaaccgtttgctgcattagcgttcaaaattatggctgacccatttgtaggaagattaactttcttccgtgtatattcaggaactgttgattctggatcgtatgtattaaattcaacaaaagataagaaagaacgtttaggacgtattcttcaaatgcatgccaataaacgtaatgaaatccaaacagtttatgctggggatatcgcagctgctgtagggtttaaaaatacaactactggggatactatctgtgacgaaaagaatttcgttattcttgaaaaaatggaattccctgaaccagttattgaacttgctattgaaccaaaaacaaaacaagatcaagataaattaggtgttggattatctaaattagctgaagaagatccaactttcagaacatttacaaaccctgaaactggtgatacagttatcgcaggtatgggtgaattacacttagatgtaatcgttgaccgtttaagaagagaatacaaagtagaagctaacgtaggtgctccacaagtagcttatcgtgaaacaatcaaaacagctgctgaatgtgaaggtaaatatgttaaacaatctggtggtcgtggacaatacggtcacgtatggatcaaatttgaacctaatgaaggtaaaggatttgaattcgttgatgctatcgttgggggatctgttccaagagaatacattaactctgttaaagtaggtcttgaagatgctcttgcaactgggatgattgctggatatccagtattagatgttaaagcgacattatttgatggttcttaccatgatgtcgattcatcagaaatggcatataaagttgctgcaagtatggcattaaaagctgctggtaaaaaatgtgatccagttatcttagagccaatcatggctgtagaagtaactgcacctgctgaatacttaggtagtgtaatgggtgacgtatcttcacgtcgtggtatgatcgaaggacaagaagaaagaggaaatgctgttacagtgcaagctagtattcctttatcagaaatgttcggatatgctactgatttaagatcatttacacaaggtcgtggtaactacacaatgatcttcgatcgttatgaaccagtacctaaatctattagagaagaaattattaagaaaaacggtggaaacaactagtatccaatcaaaatcttattgattttttcaactaaataaattagaatgtatatgtacaaaaatataaactaggaggaaccttaaatggctaaggaaaaatttgaccgctcaaaagcgcatgtaaatatcggaactattggtcacgttgaccatggtaaaacaactttaactgctgctattacaacagtattatcaaaagatggacaagctcaagcaatggattatgctgctatcgatgctgctccagaagaaaaagaacgtggtatcacaatcaacactgcacacgttgaataccaaactgcaactcgtcactatgcacacgttgactgtccaggccatgctgactacatcaaaaacatgatcactggtgctgcacaaatggacggtgctatcttagtagttgctgctacagatggaccaatgcctcaaacaagagaacatatcttattatctcgtcaagtaggtgtaccttacatcattgtattcttaaataaatgtgatatggttgatgacgaagaattattagacttagtagaaatggaagttcgtgaattattaaatgaatatgacttcccaggtgatgacactccagttatccgtggttctgctttaaaagctttagaaggagatccaaaatgggttccagctattcatgaattaatggaagctgttgattcttatattccaactccaactagagatactgataaaccattcttaatgccagttgaagacgtattcacaatcactggacgtggtacagttgctactggacgtgttgaacgtggacaattaaacttaaatgacccacttgaaatcgttggtattcatgaaactaaaaacactgttgctacaggtatcgaaatgttccgtaagttattagattacgctgaatctggagataacgtaggggttttattaagaggtgttaaccgtgaagaaattcaacgtggacaagtattagctaaacctggatcagttaatccacacaaaaaattcaaatctcaagtgtatatcttaagtaaagatgaaggtggacgtcatactcctttcttcgctaactatagaccacaattctacttcagaactactgacgtaactggtgttattgaattaccagaaggtgtagaaatggttatgcctggggataacgttgaattaactgtagaattaattgctccaattgcaattgaaaaaggaactaaattctcaatccgtgaaggtggtagaactgtaggttctggaaatatctctgatattattgaataataattacagaaatttggaaagtcacattagtggctttctttttttacattttgaaaataattgaaaccgcttgaaaagcacccttcacttaggtataatataagagcagatataaatctgaaaattcattgttataaggagatatcaaaatggatgaacaagaacaaatcgtaattaacctaattgtaaacagtggtagtgctcgtagctctgcaattgaagcaattcaatatgcaaaagctggtgacttagcaaaagctgatgaatcattacaacaagctaaagaaacagtaaacgaagctcatcattctcaaacagaattaattcaagctgaaattcgtggagaaaaagcaccattaaacttattaatggtacatgctcaagaccacttaatgactgctttggtagttattgacttagctcaagaatttattgatgtttacaaaaaaatcgggtaattttactagttaggtgaataaataccattcctttttgaaggagtggtatttttttacaaaaaaagacaaaaaaggctttacaagacaaaagggatatggtaaattaaataggcactcgaggaaagggacgtaaggaccggagagaaaaagcaaaaaaagttaaaaaaaagattgactaaaaagcgaaaagagtgtaagatattcaagtcggcaaaagaagccggagagatcattgaaaactaaacagaattaagaaacacacgtcaatatccagaaggataaaaaagaaaaaagagctaaacaaacgaagagttgtttaaataaacaatggagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtggggatggatcacctcctttctaaggagaaacgcatgatcgaagatgatgcacaagagaagtgatgtttcgaagatactgtttagttttgagtgatactcaggtatgactcagagatcattgaaaactggataatagaaaataaattgcgatagaaatagaaaatgagatcgaaatagtaattgttattattgaggtctttctagaaaagtcgaaaactaagaattttcatcactaaaaaacataaatcgaaacggatggatggattttagtaaatagttgaaaatagtaatcaagcaaacaccaaaataggtaaagtaagaaagagcgtatggcggatgcctaggcacagagaggcgaagaaggacgcagcaaacagcgaaatgcgacggttagcagtaagcatgcaacgatccgtcgatgtccgaatgggggaacccacctggagtagagaccaggtatcctgaagtgaataaatagcttcagagaggcgagactcagggaactgaaacatctaagtacctgaaggaagagaaaataaacgaatgattccctaagtagcggcgagcgaaaggggaagagcccaaaccgatcttaggatcggggttgtaggactgtcggcaaagagcaagaaatcattataggcgaacggaatgggaagtccggcgaaacagggtgacagccccgtagccgaaatagtgaagaagcacgagacagcacctgagtacggcgggacacgaggaatcctgtcggaatccaccaggaccatctggtaaggctaaatactcctctgtgaccgatagtgaaccagtaccgtgagggaaaggtgaaaagaaccccgggaggggagtgaaatagaacctgaaaccatatgcttacaagaagttagagcccgttaaagggtgatagcgtgccttttgtagaatgaaccggcgagttacgatatggagcgaggttaagcaggatatgcggagccgaagcgaaagcgagtcttaatagggcgaaagttgcatgtcgtagacccgaaaccgagtgatctagccatgaccaggttgaagttggggtaaaacccgatggaggaccgaaccgacccccgttgaaacgttggcggatgagttgtggctaggggtgaaattccaatcgaactcggagatagctggttctccccgaaatagctttagggctagcgtcgaggtaaagtcgtgtgaaggtagagcactgaatatgtgatggccccatctcggggtactgaacataatcaaactccgaatgtcacaaagatatactcggcagtcagacagtgggtgataaggtccattgtcaaaagggaaacagcccagaccatcagctaaggtcccaaaatatatactaagtggaaaaggatgtggagatgtccagacaactaggaggttggctcagaagcagccatcctttaaagagtgcgtaacagctcactagtcgaatgactctgcgccgataatttaccggggctaagtatattaccgaagctatggatttacgcgtaagcgtgagtggtaggggagcgttctatgtgcggagaagcggtaccgtaaggagccgtggagcgcatagaagagagaatgccggtgtgagtagcgaaacgtgggtgagaatcccacgcaccgaaaacccaaggtttccagaggaaggttcgtccgctctgggtaagtcgggacctaaggcgaggccgagaggcgtagtcgatggacaacaggtagagattcctgtacttacggtatgaatgatggagtgacggagaaggctagcggatcctgctgatggaaatgcaggtgcaagcgaggtagccgacagccaggcaaatccggctgtcgaaaggcaaaggcgtgaggcgtatggaaagctgcggcaagtacagaagtccgtgaagccagcttccaagaaaagcttctagtgataatcatacagtaacccgtaccgaaaatggacacacatgggtgaggagagaatcctaaggtgagcgagagaactatagctaaggaactctgcaaaatgactccgtaacttagggataaggagtgctcatagagatatgagccgcagtgaaacggcccaagcgactgtttaccaaaaacacagctctatgctaagtcgaaagacgacgtatatggggtgacgcctgcccggtgctggaaggttaagaggatgtgtcagcgcaagcgaagcattgaattgaagccccagtaaacggcggccgtaactataacggtcctaaggtagcgaaattccttgtcaggtaagttctgacccgcacgaaaggcgtaacgatttgggcgctgtctcagctgtagactcggtgaagtcttagtacctgtgaagatgcaggttacccgcgactagacggaaagaccccatggagctttactgtagcttgatattggactttgatgcaagatgtacaggataggtaggagactgagagacatgcacgccagtgtgtgaggagtcaatgttgggatactactcttcttgtattggagttctaaccggatgccatggaactggcaacgggacagtgtcaggtgggcagtttgactggggcggtcgcctcccaaagagtaacggaggcgcccaaagataccctcagcttggatggaaatcaagcgcagagtgcaaaggcataagggtgtttgactgcgagacctacaagtcgagcagggacgaaagtcgggcttagtgatccggcggtgctgaatggaaaggccgtcgctcaacggataaaagctaccctggggataacaggctgatctcccccaagagttcacatcgacggggaggtttggcacctcgatgtcggctcatcgcatcctggagctgaagtcggttccaagggttgggctgttcgcccattaaagcggtacgcgagctgggttcagaacgtcgtgagacagttcggtccctatctgtcgtgggcgtaggaagtttgagaagatctgtcctcagtacgagaggaccgggatggacatatcaatggtgcaccagttgtcacgccagtggcacagctgggtagctaaatatggaagggataaacgctgaaggcatctaagtgtgaaacccacttcaagatgagacttcccattacgcaagtaagtaagaccccttaaagacgataaggttgataggtcaggagtgtaagcatggcgacatgttcagcggactgatactaataggtcgaggacttaacctagagaaaaagggttaaggcttgaaactgaaagaagacaaagtggaagacaaaagacgcaagaaaactattatctagttttgagtgattctcgaaaggaattgcttagaaaagaagatctggtagcgatagcatgatggacacacctgttcccataccgaacacagaagttaagcatcataacggcgaagatagtaccaaggtgcgacaatagcaagctgccggttctttttttatttacggatacctctgcgtatcctttttttattttatatccggctttaatataagcagttctggatgaattatgtcgtctatcatcgacttactgctatagttttaatcagcccgggttatcagctgttgtgatttttcctgcaggatcaggatagattatctaaggcaggtaaaaatatttatgatcgtgcaggcgataaagtaaactctaacagagctggtacaggcattttatttaaaataagagcgtttggcgaagaatcagataaaatatcagcagacatgatgtttttgcgttgtattgaaaaatagacctgtttttaattctttaaaaaaaagaagggacggttaataaaatagctatatttaataaaaaaataaaatcagaaaagagtcgaaaaaatgggagaaaaaagggaagtcacaaaataatgtgaaaataactctttacaagacaaaagggatatggtaaattaaataggcactcgaggaaagggacgtaaggaccggagagaaaaagcaaaaaaagttaaaaaaaagattgactaaaaagcgaaaagagtgtaagatattcaagtcggcaaaagaagccggagagatcattgaaaactaaacagaattaagaaacacacgtcaatatccagaaggataaaaaagaaaaaagagctaaacaaacgaagagttgtttaaataaacaatggagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatagtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtggggatggatcacctcctttctaaggagaaacgcatgatcgaagatgatgcacaagagaagtgatgtttcgaagatactgtttagttttgagtgatactcaggtatgactcagagatcattgaaaactggataatagaaaataaattgcgatagaaatagaaaatgagatcgaaatagtaattgttattattgaggtctttctagaaaagtcgaaaactaagaattttcatcactaaaaaacataaatcgaaacggatggatggattttagtaaatagttgaaaatagtaatcaagcaaacaccaaaataggtaaagtaagaaagagcgtatggcggatgcctaggcacagagaggcgaagaaggacgcagcaaacagcgaaatgcgacggttagcagtaagcatgcaacgatccgtcgatgtccgaatgggggaacccacctggagtagagaccaggtatcctgaagtgaataaatagcttcagagaggcgagactcagggaactgaaacatctaagtacctgaaggaagagaaaataaacgaatgattccctaagtagcggcgagcgaaaggggaagagcccaaaccgatcttaggatcggggttgtaggactgtcggcaaagagcaagaaatcattataggcgaacggaatgggaagtccggcgaaacagggtgacagccccgtagccgaaatagtgaagaagcacgagacagcacctgagtacggcgggacacgaggaatcctgtcggaatccaccaggaccatctggtaaggctaaatactcctctgtgaccgatagtgaaccagtaccgtgagggaaaggtgaaaagaaccccgggaggggagtgaaatagaacctgaaaccatatgcttacaagaagttagagcccgttaaagggtgatagcgtgccttttgtagaatgaaccggcgagttacgatatggagcgaggttaagcaggatatgcggagccgaagcaaaagcgagtcttaatagggcgaaagttgcatgtcgtagacccgaaaccgagtgatctagccatgaccaggttgaagttggggtaaaacccgatggaggaccgaaccgacccccgttgaaacgttggcggatgagttgtggctaggggtgaaattccaatcgaactcggagatagctggttctccccgaaatagctttagggctagcgtcgaggtaaagtcgtgtgaaggtagagcactgaatatgtgatggccccatctcggggtactgaacataatcaaactccgaatgtcacaaagatatactcggcagtcagacagtgggtgataaggtccattgtcaaaagggaaacagcccagaccatcagctaaggtcccaaaatatatactaagtggaaaaggatgtggagatgtccagacaactaggaggttggctcagaagcagccatcctttaaagagtgcgtaacagctcactagtcgaatgactctgcgccgataatttaccggggctaagtatattaccgaagctatggatttacgcgtaagcgtgagtggtaggggagcgttctatgtgcggagaagcggtaccgtaaggagccgtggagcgcatagaagagagaatgccggtgtgagtagcgaaacgtgggtgagaatcccacgcaccgaaaacccaaggtttccagaggaaggttcgtccgctctgggtaagtcgggacctaaggcgaggccgagaggcgtagtcgatggacaacaggtagagattcctgtacttacggtatgaatgatggagtgacggagaaggctagcggatcctgctgatggaaatgcaggtgcaagcgaggtagccgacagccaggcaaatccggctgtcgaaaggcaaaggcgtgaggcgtatggaaagctgcggcaagtacagaagtccgtgaagccagcttccaagaaaagcttctagtgataatcatacagtaacccgtaccgaaaatggacacacatgggtgaggagagaatcctaaggtgagcgagagaactatagctaaggaactctgcaaaatgactccgtaacttagggataaggagtgctcatagagatatgagccgcagtgaaacggcccaagcgactgtttaccaaaaacacagctctatgctaagtcgaaagacgacgtatatggggtgacgcctgcccggtgctggaaggttaagaggatgtgtcagcgcaagcgaagcattgaattgaagccccagtaaacggcggccgtaactataacggtcctaaggtagcgaaattccttgtcaggtaagttctgacccgcacgaaaggcgtaacgatttgggcgctgtctcagctgtagactcggtgaagtcttagtacctgtgaagatgcaggttacccgcgactagacggaaagaccccatggagctttactgtagcttgatattggactttgatgcaagatgtacaggataggtaggagactgagagacatgcacgccagtgtgtgaggagtcaatgttgggatactactcttcttgtattggagttctaaccggatgccatggaactggcaacgggacagtgtcaggtgggcagtttgactggggcggtcgcctcccaaagagtaacggaggcgcccaaagataccctcagcttggatggaaatcaagcgcagagtgcaaaggcataagggtgtttgactgcgagacctacaagtcgagcagggacgaaagtcgggcttagtgatccggcggtgctgaatggaaaggccgtcgctcaacggataaaagctaccctggggataacaggctgatctcccccaagagttcacatcgacggggaggtttggcacctcgatgtcggctcatcgcatcctggagctgaagtcggttccaagggttgggctgttcgcccattaaagcggtacgcgagctgggttcagaacgtcgtgagacagttcggtccctatctgtcgtgggcgtaggaagtttgagaagatctgtcctcagtacgagaggaccgggatggacatatcaatggtgcaccagttgtcacgccagtggcacagctgggtagctaaatatggaagggataaacgctgaaggcatctaagtgtgaaacccacttcaagatgagacttcccattacgcaagtaagtaagaccccttaaagacgataaggttgataggtcaggagtgtaagcatggcgacatgttcagcggactgatactaataggtcgaggacttaacctagagaaaaagggttaaggcttgaaactgaaagaagacaaagtggaagacaaaagacgcaagaaaactattatctagttttgagtgattctcgaaaggaattgcttagaaaagaagatctggtagcgatagcatgatggacacacctgttcccataccgaacacagaagttaagcatcataacggcgaagatagtaccaaggtgcgacaatagcaagctgccggttctttttttatttacggatacctctgcgtatcctttttttattttatatccggctttaatataagcagttctggatgaattatgtcgtctatcatcgacttactgctatagttttaatcagcccgggttatcagctgttattaagataataacagctgttgtgatttttcctgcaggatcaggatagattatctaaggcaggtaactatataaaattcaagtgtttttatgaaaaagttaaaaaatgttaaaataaatgattttatatgttaagtagtatagatccttgaaatgtgaataatgatttttaatttttggggatgaaaaaaaaaaaaaaaatgggtttttttttatttttaattatttttttttttttaaaaagggaataaaaaaatttttttggtatttgaaaaaaaaaaaaaaatttaaaaaaatttttaaaaaaaaagccaaaaaaaaaaaggaagatttttaccttgaaaaatttttaaaaaaaaaaatttttaaatacgggattttttttattaataaaggaaaaataatttgaaataaagtttttttaaaaaatggtaatttttttttggaaaaagaggttttttgtgggttttttttatttaattttaaaaaaaaaggggaaaaacaggggttttttatttttttagagggtttaaaatagttttttatttttcttaatttggaaaaaaaaaaaaaacaagagaaaaaaaaaatcggggggggggagggaggggggggttttttggggggaaaattttttttttttttttatttttttaaaaaaattgttaataaaaaaattaaatttatataatagattttttttttttatttttttggggggagaaaaaaataaaaaaaaaaattgtagagaagtttttggggtgaggggagagaggtggggtggtctgggcgttttataaaaaaaaataatagaaaaaaaataataaaataataataaataatttaaaaagaaaaaaaaaataataaaaataaaaaaaaaaaaaaaaaaaaaaaaaaaaaaaaaaaaaaaaaaaaaaaaaaaaaataatttgttgggggtggaataatatattttttttttttttttttatttgatttgttttttatttttttaaaaaaaaagaagtggatgttttattaattaaattttttatttttttaaaaaaaaaaaaaaaaaaaaaaaaaaagaagaaggttatttttattattttttttgattgtgtttgtaattaaaaaaagaaaaaaagtttgaagaaaaaaaaaaaaataaaattattttttataaaaaaaaaataaaaaaaggattgggatgtataaataaaaaaaaaaaaaaaaaagaaaaaaaaatttgaataaaaaataaattaataagggagaggaaaaattaaatttttatttttattaaaaaaaaaaaaaaaaaaaaaaaaaaaaaaataaaaaaaaaaaaaaaaaaaaataaaaaaaaaaaaaaaaaaaaaaaaaaaaaaaaaaaaaaaaaaaaaaaaaaaaaaaataaaaaattaattaaaaataaataatggggggggggggaaaggggaaaggaaaaaaaaaaaaaagaaaaaaaaaaaaatataaattaaaataataaataatttaaataataaattaaaaaaaaataaaaaaggggggggggtgtttcaggtaaaaatatttatgatcgtgcaggcgataaagtaaactctaacagagctggtacaggcattttatttaaaataagagcgtttggcgaagaatcagataaaatatcagcagacatgatgtttttgcgttgtattgaaaaatagacctgtttttaattctttaaaaaaaagaagggacggttaataaaatagctatatttaataaaaaaataaaatcagaaaagagtcgaaaaaatgggagaaaaaagggaagtcacaaaataatgtgaaaataactctttacaagacaaaagggatatggtaaattaaataggcactcgaggaaagggacgtaaggaccggagagaaaaagcaaaaaaagttaaaaaaaagattgactaaaaagcgaaaagagtgtaagatattcaagtcggcaaaagaagccggagagatcattgaaaactaaacagaattaagaaacacacgtcaatatccagaaggataaaaaagaaaaaagagctaaacaaacgaagagttgtttaaataaacaatggagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtggggatggatcacctcctttctaaggagaaacgcatgatcgaagatgatgcacaagagaagtgatgtttcgaagatactgtttagttttgagtgatactcaggtatgactcagagatcattgaaaactggataatagaaaataaattgcgatagaaatagaaaatgagatcgaaatagtaattgttattattgaggtctttctagaaaagtcgaaaactaagaattttcatcactaaaaaacataaatcgaaacggatggatggattttagtaaatagttgaaaatagtaatcaagcaaacaccaaaataggtaaagtaagaaagagcgtatggcggatgcctaggcacagagaggcgaagaaggacgcagcaaacagcgaaatgcgacggttagcagtaagcatgcaacgatccgtcgatgtccgaatgggggaacccacctggagtagagaccaggtatcctgaagtgaataaatagcttcagagaggcgagactcagggaactgaaacatctaagtacctgaaggaagagaaaataaacgaatgattccctaagtagcggcgagcgaaaggggaagagcccaaaccgatcttaggatcggggttgtaggactgtcggcaaagagcaagaaatcattataggcgaacggaatgggaagtccggcgaaacagggtgacagccccgtagccgaaatagtgaagaagcacgagacagcacctgagtacggcgggacacgaggaatcctgtcggaatccaccaggaccatctggtaaggctaaatactcctctgtgaccgatagtgaaccagtaccgtgagggaaaggtgaaaagaaccccgggaggggagtgaaatagaacctgaaaccatatgcttacaagaagttagagcccgttaaagggtgatagcgtgccttttgtagaatgaaccggcgagttacgatatggagcgaggttaagcaggatatgcggagccgaagcgaaagcgagtcttaatagggcgaaagttgcatgtcgtagacccgaaaccgagtgatctagccatgaccaggttgaagttggggtaaaacccgatggaggaccgaaccgacccccgttgaaacgttggcggatgagttgtggctaggggtgaaattccaatcgaactcggagatagctggttctccccgaaatagctttagggctagcgtcgaggtaaagtcgtgtgaaggtagagcactgaatatgtgatggccccatctcggggtactgaacataatcaaactccgaatgtcacaaagatatactcggcagtcagacagtgggtgataaggtccattgtcaaaagggaaacagcccagaccatcagctaaggtcccaaaatatatactaagtggaaaaggatgtggagatgtccagacaactaggaggttggctcagaagcagccatcctttaaagagtgcgtaacagctcactagtcgaatgactctgcgccgataatttaccggggctaagtatattaccgaagctatggatttacgcgtaagcgtgagtggtaggggagcgttctatgtgcggagaagcggtaccgtaaggagccgtggagcgcatagaagagagaatgccggtgtgagtagcgaactgattacgtgcagttaaaaaaagaagaagaaaagcttgaaaaagatttagaaaaggaaaaaagacttcaggaggcaactttgaaactgaagcagaaatatgggaaaaatgctgtattaaaaggtataaatctagtaaagggagcaactggcaaagacagaaacaatactattgggggacataaaaaatgaagaagttttcattttttatgaaatccatcctttcataaggcatgggtgctattattcatttaaagcattatatttcaaaaaagcttctacctacgtatttagagaaaaacttttagcgcagtttgcgccgttttctgtttttatcgggatataaagagcaattagaaaaagcaggctaattagacagaatggattaaaaagtattattgttaaaatagaaataaggtaataaaagtactctatttgtcaaatgacaaatgaataaacagtattcagatgacttacatagtttatcacacacaaaatggagttgcaaatatcatattgtatttgcaccaaaatatagaagaagagcattttatgaagcaagaagggtagaggtaggagcaatactaagacaattatgtgaatggaaaggcgtaaatataatagaagcggaagtatgcatagatcatgtacatatgttagtagaaataccgcccaaatatagtgtttcagggtttatggggtttttaaagggaaaaagcagtcaaatgatatatgaaagatgggcaaatacaagatataagtacaaacatagagagttctggtgtcgaggatattatgtagatacagtaggaaagaatacgaaaagaataaaaaatcatatagcgaatcaattaaaagaagatcaggaaagagaacagctgacactggatttggaagacccgtttaaaaaaggaaaagggagaaactaaataaatatagagtgcacgcggtagccgtaggcataaggagtgtcttgagaaatgtgctctgagagcagggctatgcccgcaaatgtaaaaccaccggctaagccggtggatatttattcgtctaaaataaatcttcatatatttttgaaatgactttagaaagattttgaaaagttggttcttttttgatttcttctaatgttgtgttatttgagattaaaaatgataagtaaaaccataatttaaaggcgttaggattatttttttgtattgaaacaagaaaaacaatatctacatattcatcatcccataaaatgggttttggtaatatagcaacagaaataaaagatgtttcacttgaaaaaatttcaggatgtggtattgctaaataattaccaaaataagtggaagtaacattttcgtgattcataattgaatgatatagtttttcatctgctaagccttgcttataagccatttcataaagacattttataacggcgtttttagatggagcatctccataatagaacaaatcttcactaaaacaatctaaaatatcttttgggccattgaacccctctagaagtaattcaattttcttgatatcagtgtcatttaaaaaataagaaattttttgtattttattattattaatgaatatatcattttcagttgtacatattacattataattatccacattagtagttgataacgaatttttaggaataattttaacttcttttattgatgggaaatttctcaaaatattattttgaagcaaaatagtctcacttcttcttaaagaactaatgattaacattcttttctttttttgtagagaattttcatctatataatttacaaaatgtaaagcaacatatgtaatttcatcatctaaaatttttttatcacttggtataattgtattggtgaaagtagaagctaggtcatatgcaagtgtgtatttttgcttaatattgaatgtcataatatttcttaactgcatattagtatttatacgagttaaaagaggtaaaatatgtaaacctaatgatattcgtagattgagattagaggtaaaatctaaaccaaatatttctttgattttatataagcctaaaaaaactaaattattaatttcatcagtaataaattcctgtttatcaaattctcttttaccatataaatttaaggctagaaaaaagatttcatcatcattaaactcaaaattatatatatctgcacatttttctaatatattttttgaaatgtcgatgacatgtgcatacactggcgatatatttagtgaatccatatgaataagatgacctgacttaatacgattaacagtagtaacaatatgcaagataaggttttgaagggcaatatcagaaattatataatgtgagtgagtgagaattttaataacaatattatttatatcattaatatgttcatgtgaattaaaagtatgtgtaatctcatcacaaaccaaatttttaatttttaatttttcttgaataatataattacgaatatcattttctttgccaataattttaataccataataaggtttagatataagagttaaatgatatgaagataatatgtttttagctaatttaatgtcattagatatttgggaacggcttatatacatttcatctgctaaatctgcactttttaaataatcatttgaatctaacaacctagaaatcatataggaaatacgagaagattggtcttcaaaaaattgattaaggttataatcttgtatgattgaattcataaatatattagcagtttcttgattagtgatagacatacaaatacaatttttgttattttcgatatataaaccatgttctttaatggtttcctttatttcagcaatatcagtttgtatagagcgaatgcttaaatgaaactgatctgtaaagacttgtagagaaacaggtgcatctaagtttgaaaataaatttagtaatatttcattttgacgtttggtgagcataaaaaatacctcctaatctaataatattataagtatatttattatatcataaaccttaattgagaaaagattttacaatttgatttttattgcactgtttttcataaaaattttgaaaaaaaatacaaccaaattgtttcattaattttaggaaaaagtatgtaaatatctaaaaactgatttgtgataaaatcacattgtaaggaaagtaaggattataagaataaaataatatagagggagggtaaaaaagtgtaataatcattatgtattcttacttattttgaaatagagatggaggtgatagagcatgataaatattttagtagtaactcatggaaattttggtaacgaattaattaaaagtgcagaaatgattgctggaaagcaagagaatattgagtcgctaggcttatttgtagaagatgattttgatatgtttaaaagtaaagtgaaaaataaaattaaagaattggaaaatgaagaaggtgtgttagtgctcgtcgatatgtttggggggactccttctaacgcatcatttgcaaatttaaataatttagattttgaatgtgtaacaggtttgaatttgccgatgatgttggaagtattaattaatagaaatataaaaacacttaaagaactcgtgaatatagcagttgatgttaaaaaaaatagtatatttaatttaagggacatagttttagaaaaatgatggaaaggggaaactaaaatggaaataggattaattagggtagatagtagacttattcatggacaagttattacaaaatggttaaattattccaaagcaaatgtaattgttgttgttgatgatgaactctcaaaagatagttttatgtcagaaatatacacggcctctgctccaaatggaattgttgtagaaattttaagcattgatgattttatgaaaaatactgtcactcataaatatagtaataaaagacttttaattttattaaaaaatattgaaacagtttatgaactttacttaagacaatttaaaatgaaacatattcaactgggaggattaccaagcggtgtaggaaaaaaagcaatatacaaagctatttatcttaatgaagaggaaattaataaattaagagatattgccaattctggtgtgtatattgatatgcaggttataccagaagatacaaaatctgatttaatgaaaatgataaaataagggggataaaaaatggaattatcattagcgatttgtgctggattatggtattggattgccagaacacaagtgggatatacattacatgcaattttatgtcagccattagtaatggcgctaccgtttggattgatttatgggaatttatcacaagcaatgattattgccgcaagtattcaaatggtgtatttaggattagtaggaaatggaggaaatttaccggctgatgaatgtttggctggatgtgtagcaattccaattgctttagttagtcaaatggatcctggacaagcagttgttttagcgatgccctttggattaattggagttttacaagatcaacttagaagaattatcaatgctatttttcttcatagagcagataaaatggcagaggttggaaacataaaagagattgaacgttgtgcaattgtgtatccaataattttaggattctttttaagattcccaattgtatttgcgattacatatgcaggtgctgatacagtgcaaaatattttagcttctatgcctgaatggattacgcatggattaagtgttgcaggaggtgttttaccagcgatgggatttgcaatgacaatttatattattggaaaaaaacaatatttaccatttttcattattgcatttttcatggttcaatatttaaaaattaatgtaatggctgctgctatttttggaacttgtattgcattgttaattgttttattgaaaagagaaaaaaatacggagggagctatttaatatggatgaagtagaaaaaaacaaaactgttgagaaagatatgaaaaaattagttaataaatcatggtttagatattggctttcagctgagatgtcaaattcatacgaaagactacaatcattatcgttttgttatagtatcattcctgttttaaaaaaattatatccaaataaagaagaatttggagaggcgattaagagacatttaaacttttttaatactgaaccaacttggggctcaccaattttaggaattgcaattgctatggaagaagaaaaagcaaaaactaagcaaataccaggagaggcaattacatcgttaaaaacaggattgatgggtccattagcaggaattggtgacacaatcgattggggcacattaaaaacaatcatttatggtattgctgttactttcgcatcatcaggtaatatattaggggcatttattcctttggcatttacatgtttaacttttattattggtaggtatctaacgaatttcggttatactgttggaaaggattcagtaaaatctatattacaacagggatggattaaggaacttatttttggaacaagtattttgggattattcatgatgggggcattaacaagtaattttgttgaaataataacaccattatcttttgaaatagcaaaagggcaaacgctagctattcaagaaattttagatagtattgtaccaggtttactacctttgtgtgcggtgtttggtatttattatttcttaaaaaaaggaaaagttaattatggagttttagctattggaattgtagttatttgtttagtggcttcatttttgggagttttataggatgaaaaatgtagtgatagtaggggcaggtaaggaaggaaaaggaacatttggtgatatattttatgaaaataaatggaatataacttttattgataaagatgaaaacgttattaattcattaaacgagaagaatagttatatagttgaagccctatatgaaaattataacgaaaaacatattattgatcattatcatgcatatcttattgatgattacaataatagttatgaatctattcttaatgctgatgttatcgttttggcattatatcctgaagatataaaagaagctttaagtaaattgaagttttctttgcaaaagagaataaaaagtaattatgaacaaaaattaacaattttatgtggaacaaataaaaatcacatgatatcaaaattagaaaatttcttattagatgatttaaaaatcgaaaagaaatggtactgttcaaatgttgcgctacgggacatgattattagaagaagttctaattctgatgcaaaagatgctgttcaattaactacgaagatagtacaaacgttattaatacaaagtcctgtctattttgatatttctaaatttaaatggtttgaattaaataataatttggaaatgatgaaagatattaaattatttacctataattcaccacatgcagcatgtgcgtatgttggttataagtacggatatcaaactattgaagaagcgagtaaaaataaagacattaaaacaattatggaagcttgtgttttagaagcaaaaaaaggtattttatcctcgtttgaaattacagcagaagaattagatgattttgttgatgcaccgaaaccaaatggagaagaaaaggagtatattacaagagttgcattggatccaattagaaaactatccagaaatgatagattaacaggaatagcgatgatttgtatggaaaataatattgaatgtccaaatttgattaaagcaattgcgtatggcatgagttacgattgtaaagaagacatatcagcaaaaaagattcaaaatcttattcttgaaaagggaattaaaaaggcaattagcgatgtgattggtgttgatgaaatgcatccaattataaagaagatacaaaatgaatatttaaaaataagataaaataaataaaagtctatttatcaaaatttaaaactttgaaattagacttttttatttaataagcatatggaagagtcgggcgtttattaaaaacaaaattagattacagtaaaaaatctatgaagtatatttaaaatatgcctcagatgtaaatatccatgtttattcaattgatggggtttttattgatgcaacgtgctatcttaagactgtcaataaatttccaaaggaatttgcaaaaatgattattcaggatatttataaaacaacgggaataacagctacagcaggaataggtacaaacttatatcttgcgaaagtggcaatatgcttatcataaacgagaaaaatacataagtacaaggcctgtacagaagaatcatatcatactatgccagatggaatactaataggttgtgacttagataaaaacggaaatgttaggataatgcatatggataacgaaatcatgtagcaaggggaaaataaataatgataacaaaaaaattaaaagcaatcttgtccttgcgtggtcttgcatttgcagattatgcacgtaagttaggaataacatgataatccttaaataaaaaaagaaaaaataacacttataaaataagtgatattatcgaatttgcggaattgacgaatgcaaaattagtgcttatcgatgaagaaacaaacgaaattttgataaagtttaacaaagaaaatctaaatgaagaggaaaaataaaaaagaacttataagttcttttttatcaataaatttcggtaattctataacaatacatcttatgttgttattattttcgcagttctatactaaagacataatttcaatacactaatatgttgttattggatatctttattatagtacattaatatagaaatgtaaatttcaaaaaaaacagtatggctaatgattaaagagttattgatattaataaaatttatgcgataatattaaacggtgattattgtgagagacagagaaattatagcaagaaacttaattaatattatagacgtgaaaaactgtcagtattttagtcagtttatgaatgatgatttatatgacaaactgtatgattatcttataaaattgagtagaggaaatgacaaggcggttgctcatataaaactaatgatggaagagtgcagaccgactattgaaaaaatcgaaaaagacgaacagatttctaatgatgaattcaattcttttatggaaaaattcagagtgtttaaaaggaaatatcttatgtaaaaatgcttttccaacatcataaataccgtacagctgttataaaaaatgttttttgggggataaaagaatgattgagatttatgatctaaacgataaattaataacaagagttagtaatcaggatcagcttgatgagtttatggatgataatgaatttgaatatccagaagttattataaaagagaacggtaaaaaaaggaaatatacttttgaagacagtgaatttgagtcatccaaaagggagctgttgaaaaaatcaaaatattttcatatgagcaggatatgtgctttagcaaatgtagattattattcatttaacctctggaaaaataaaggaatatttgttttaacgcctaaagaaatagatgctttatatgatgcaataagtcatgtatgtaaatgatggaatagtgcagaataagaaaggggtaagatggttaatagagcagtcctggtaggacgaatgacgagggatcctgaacttagtagaacacttcaaggtgatgcggttacttcttttactttagcggtaaatcgtaattttacaagcagagatggtcaacaacaggcagattttattaattgtgttgtatggcgtaagtctgctgaaaatgttgaaagatattgttctaagggaagtttagttggtgttgaagggagaatacagacacgcagttacgaaaatcctcaaggtcaaaagaaatacattgtagaagttatttgcgacgtagttcaatttatggaaactagagcggtaaatgaagaacagtcaaaaaaagatatttatcaaactgattataatgaaaatagtttattgcgtgaccttgaaaaagaatttgataattctttaaatacttttgaaatatcagaggatgatttgccattttgataatttataatagtattatttttaaaaagacagtaatttctgaatataatgttgtaataaaaaagctagggaaataggtgaaaatcaacaatattttggttagtaaaagtaatatttatatcaaaatattagaaaatgaaagtgaaaaagataaaatgataaaaaagaggcagtttgcctctttttgtgataaatatagtaaaaaaattgcaccttttaattataaaaacagacatgctatgctttttatatagttcaactcaatatgtataaagcaaattggagagcagtcaaaaaagacatttattagtctgattataaagagaataatttatcgcatgatcatgaaaaaaatttgatatttctataaatacttttgaaatagtaggatgatttgctactaataatttatgatagtattattaatgattaaaaatagcgcaccaaggtttattttaaacatattaatatatttccgctgctgcagtagtatggggtgaataatattcaaaaaacactcactttttcgaaaaaaattgtgcctttttgaaatgaaggatatgttaaaattagtatagttaaaattatgtaaagagacagggaatgagaatgtctctttttattttaactgaaaataataaatgttaaggggtgagaacgttgtatggaattaagttgatgccataatatatttgattttttttacgtatatggttataaaaaaacaattttacattaaattatatttt

SEQ ID NO: 19-20 - skipped (2 entries)
